United States Patent
Wang et al.

(10) Patent No.: US 11,433,100 B2
(45) Date of Patent: Sep. 6, 2022

(54) COMPOSITIONS AND METHODS FOR TREATING CEACAM POSITIVE CANCERS

(71) Applicant: A2 Biotherapeutics, Inc., Agoura Hills, CA (US)

(72) Inventors: Xueyin Wang, Agoura Hills, CA (US); Carl Alexander Kamb, Westlake Village, CA (US); Han Xu, Agoura Hills, CA (US); Mark L. Sandberg, Agoura Hills, CA (US); Dora Toledo Warshaviak, Agoura Hills, CA (US)

(73) Assignee: A2 Biotherapeutics, Inc., Agoura Hills, CA (US)

( * ) Notice: Subject to any disclaimer, the term of this patent is extended or adjusted under 35 U.S.C. 154(b) by 0 days.

(21) Appl. No.: 17/517,559

(22) Filed: Nov. 2, 2021

(65) Prior Publication Data

US 2022/0054551 A1 Feb. 24, 2022

Related U.S. Application Data

(63) Continuation of application No. PCT/US2021/046774, filed on Aug. 19, 2021.

(60) Provisional application No. 63/068,244, filed on Aug. 20, 2020.

(51) Int. Cl.
| | |
|---|---|
| *A61K 35/17* | (2015.01) |
| *C07K 14/705* | (2006.01) |
| *A61P 35/00* | (2006.01) |
| *C07K 14/725* | (2006.01) |

(52) U.S. Cl.
CPC .............. *A61K 35/17* (2013.01); *A61P 35/00* (2018.01); *C07K 14/7051* (2013.01); *C07K 14/70517* (2013.01); *C07K 14/70521* (2013.01); *C07K 14/70578* (2013.01)

(58) Field of Classification Search
CPC ..... A61K 35/17; A61P 35/00; C07K 14/7051; C07K 14/70517; C07K 14/70521; C07K 14/70578
See application file for complete search history.

(56) References Cited

U.S. PATENT DOCUMENTS

| | | | |
|---|---|---|---|
| 4,690,915 | A | 9/1987 | Rosenberg |
| 5,350,674 | A | 9/1994 | Boenisch et al. |
| 5,585,362 | A | 12/1996 | Wilson et al. |
| 5,858,358 | A | 1/1999 | June et al. |
| 5,883,223 | A | 3/1999 | Gray |
| 6,326,193 | B1 | 12/2001 | Liu et al. |
| 6,352,694 | B1 | 3/2002 | June et al. |
| 6,534,055 | B1 | 3/2003 | June et al. |
| 6,692,964 | B1 | 2/2004 | June et al. |
| 6,797,514 | B2 | 9/2004 | Berenson et al. |
| 6,867,041 | B2 | 3/2005 | Berenson et al. |
| 6,887,466 | B2 | 5/2005 | June et al. |
| 6,905,680 | B2 | 6/2005 | June et al. |
| 6,905,681 | B1 | 6/2005 | June et al. |
| 6,905,874 | B2 | 6/2005 | Berenson et al. |
| 7,067,318 | B2 | 6/2006 | June et al. |
| 7,144,575 | B2 | 12/2006 | June et al. |
| 7,172,869 | B2 | 2/2007 | June et al. |
| 7,175,843 | B2 | 2/2007 | June et al. |
| 7,232,566 | B2 | 6/2007 | June et al. |
| 7,790,858 | B2 | 9/2010 | Presta |
| 8,642,742 | B2 | 2/2014 | Hofer et al. |
| 8,697,359 | B1 | 4/2014 | Zhang |
| 8,771,945 | B1 | 7/2014 | Zhang |
| 8,795,965 | B2 | 8/2014 | Zhang |
| 8,865,406 | B2 | 10/2014 | Zhang et al. |
| 8,871,445 | B2 | 10/2014 | Cong et al. |
| 9,206,260 | B2 | 12/2015 | Hofer et al. |
| 9,745,368 | B2 | 8/2017 | Milone et al. |
| 10,040,846 | B2 | 8/2018 | Frigault et al. |
| 10,172,885 | B2 | 1/2019 | Pulé et al. |
| 10,172,886 | B2 | 1/2019 | Pulé et al. |
| 11,254,726 | B2 | 2/2022 | Kamb et al. |
| 2002/0018750 | A1 | 2/2002 | Hansen et al. |
| 2003/0091561 | A1 | 5/2003 | Van et al. |
| 2003/0170238 | A1 | 9/2003 | Gruenberg et al. |
| 2004/0101519 | A1 | 5/2004 | June et al. |
| 2005/0244858 | A1 | 11/2005 | Rossi et al. |
| 2006/0034810 | A1 | 2/2006 | Riley et al. |
| 2006/0121005 | A1 | 6/2006 | Berenson et al. |
| 2009/0053184 | A1 | 2/2009 | Morgan et al. |
| 2011/0104148 | A1 | 5/2011 | Mossner et al. |
| 2012/0009162 | A1 | 1/2012 | Yasukawa et al. |
| 2014/0068797 | A1 | 3/2014 | Doudna et al. |
| 2015/0031624 | A1 | 1/2015 | Feldman et al. |
| 2015/0376296 | A1 | 12/2015 | Fedorov et al. |
| 2016/0075795 | A1 | 3/2016 | Mossner et al. |
| 2016/0108131 | A1 | 4/2016 | Berne et al. |
| 2016/0145354 | A1 | 5/2016 | Bacac et al. |
| 2016/0229923 | A1 | 8/2016 | Hofer et al. |
| 2016/0289293 | A1 | 10/2016 | Pule et al. |
| 2017/0283775 | A1 | 10/2017 | June et al. |
| 2017/0296623 | A1 | 10/2017 | Juillerat et al. |
| 2017/0355781 | A1 | 12/2017 | Markel et al. |
| 2018/0044399 | A1 | 2/2018 | Rajpal et al. |
| 2018/0079827 | A1 | 3/2018 | Hofer et al. |
| 2018/0346541 | A1 | 12/2018 | Wong et al. |

(Continued)

FOREIGN PATENT DOCUMENTS

| | | |
|---|---|---|
| EP | 2681244 B1 | 11/2017 |
| EP | 3333193 A1 | 6/2018 |

(Continued)

OTHER PUBLICATIONS

Fujiwara et al., Hinge and Transmembrane Domains of Chimeric Antigen Receptor Regulate Receptor Expression and Signaling Threshold. Cells 9(5):1182, May 9, 2020.*

(Continued)

*Primary Examiner* — Ruixiang Li
(74) *Attorney, Agent, or Firm* — James R. Whittle; Anna Mirón; Mintz, Levin, Cohn, Ferris, Glovsky and Popeo, P.C.

(57) ABSTRACT

The disclosure provides immune cells comprising a first activator receptor specific to CEA, and a second inhibitory receptor, and methods of making and using same for the treatment of cancer.

30 Claims, 53 Drawing Sheets

Specification includes a Sequence Listing.

(56) References Cited

U.S. PATENT DOCUMENTS

| | | |
|---|---|---|
| 2019/0023761 A1 | 1/2019 | Pulé et al. |
| 2019/0185583 A1 | 6/2019 | Hofer et al. |
| 2019/0185849 A1 | 6/2019 | Lundberg et al. |
| 2019/0211076 A1 | 7/2019 | Bleakley et al. |
| 2019/0248869 A1 | 8/2019 | Gross et al. |
| 2019/0359678 A1 | 11/2019 | O'Donoghue et al. |
| 2020/0016203 A1 | 1/2020 | Pulé et al. |
| 2020/0016204 A1 | 1/2020 | Pulé et al. |
| 2020/0093861 A1 | 3/2020 | Klein et al. |
| 2020/0123270 A1 | 4/2020 | Doihara et al. |
| 2020/0188434 A1 | 6/2020 | Cordoba et al. |
| 2020/0199550 A1 | 6/2020 | Cordoba et al. |
| 2020/0261499 A1 | 8/2020 | Gross et al. |
| 2020/0316120 A1 | 10/2020 | Gross et al. |
| 2021/0206826 A1 | 7/2021 | Lim et al. |
| 2021/0230247 A1 | 7/2021 | Kamb |
| 2021/0230251 A1 | 7/2021 | Gross et al. |
| 2022/0054551 A1 | 2/2022 | Wang et al. |
| 2022/0153807 A1 | 5/2022 | Kamb et al. |
| 2022/0162287 A1 | 5/2022 | Kamb et al. |

FOREIGN PATENT DOCUMENTS

| | | | |
|---|---|---|---|
| EP | 3632461 A1 | 4/2020 | |
| EP | 3634990 A1 | 4/2020 | |
| EP | 3688155 A1 | 8/2020 | |
| WO | WO1999043817 A1 | 9/1999 | |
| WO | WO200129058 A1 | 4/2001 | |
| WO | WO200196584 A2 | 12/2001 | |
| WO | WO2012117002 | 9/2012 | |
| WO | WO-2012117002 A1 * | 9/2012 | A61K 39/395 |
| WO | 2014145252 A2 | 9/2014 | |
| WO | 2015017214 A1 | 2/2015 | |
| WO | 2015075468 A1 | 5/2015 | |
| WO | WO2015120096 A2 | 8/2015 | |
| WO | WO2015142314 A1 | 9/2015 | |
| WO | 2016075612 A1 | 5/2016 | |
| WO | 2016097231 A2 | 6/2016 | |
| WO | 2016126608 A1 | 8/2016 | |
| WO | 2016138034 A1 | 9/2016 | |
| WO | WO2016142532 A1 | 9/2016 | |
| WO | WO2016160622 A2 | 10/2016 | |
| WO | WO2017011804 A1 | 1/2017 | |
| WO | 2017087723 A1 | 5/2017 | |
| WO | WO2017079705 A1 | 5/2017 | |
| WO | 2017091905 A1 | 6/2017 | |
| WO | 2017156484 A1 | 9/2017 | |
| WO | 2018039247 A1 | 3/2018 | |
| WO | WO2018061012 A1 | 4/2018 | |
| WO | 2018144535 A1 | 8/2018 | |
| WO | 2018148454 A1 | 8/2018 | |
| WO | 2018191748 A1 | 10/2018 | |
| WO | WO-2018177967 A1 * | 10/2018 | A61K 35/17 |
| WO | 2018211244 A1 | 11/2018 | |
| WO | 2018211245 A1 | 11/2018 | |
| WO | 2018211246 A1 | 11/2018 | |
| WO | 2019056099 A1 | 3/2019 | |
| WO | WO2019068007 A1 | 4/2019 | |
| WO | 2019084055 A1 | 5/2019 | |
| WO | 2019090215 A2 | 5/2019 | |
| WO | 2019241549 A1 | 12/2019 | |
| WO | 2020070290 A1 | 4/2020 | |
| WO | WO2020065406 A2 | 4/2020 | |
| WO | WO-2020172177 A1 * | 8/2020 | A61K 39/0011 |
| WO | WO2020259550 A1 | 12/2020 | |
| WO | 2021030182 A1 | 2/2021 | |
| WO | WO2021030149 A1 | 2/2021 | |
| WO | WO2021030153 A2 | 2/2021 | |
| WO | WO2021053587 A1 | 3/2021 | |
| WO | WO2021096868 A1 | 5/2021 | |
| WO | WO2021110647 A1 | 6/2021 | |
| WO | WO2021119489 A1 | 6/2021 | |
| WO | WO2021222576 A1 | 11/2021 | |
| WO | WO2021252635 | 12/2021 | |
| WO | WO 2022/036065 | 2/2022 | |
| WO | WO2022040470 | 2/2022 | |

OTHER PUBLICATIONS

Altschul et al., "Gapped BLAST and PSI-BLAST: a new generation of protein database search programs.," Nucleic Acids Res. 25:3389-3402 (1997).

Altschul et al., "Basic Local Alignment Search Tool," J. Mol. Biol. 215:403-410 (1990).

Bacac et al., "A Novel Carcinoembryonic Antigen T-Cell Bispecific Antibody (CEA TCB) for the Treatment of Solid Tumors," Clin Cancer Res 22, 3286-3297 (2016).

Barnstable et al., "Production of monoclonal antibodies to group A erythrocytes, HLA and other human cell surface antigens-new tools for genetic analysis," Cell 14(1), pp. 9-20 (1978).

Basilion et al. "Selective Killing of Cancer Cells Based on Loss of Heterozygosity and Normal Variation in the Human Genome: A New Paradigm for Anticancer Drug Therapy" Molecular Pharmacology 56:359-369 (1999).

Berge et al., "Selective expansion of a peripheral blood CD8+ memory T cell subset expressing both granzyme B and L-selectin during primary viral infection in renal allograft recipients," Transplant Proc. 30(8):3975-3977 (1998).

Bern et al., Inducible down-regulation of MHC class I results in natural killer cell tolerance. J Exp Med, 216(1), 99-116(2019).

Beroukhim et al., The landscape of somatic copy-number alteration across human cancers. Nature, 463(7283), 899-905 (2010), 17 pages.

Bird et al., "Single-Chain Antigen-Binding Proteins," Science 242:423-426 (1988).

Boland and Goel, "Microsatellite Instability in Colorectal Cancer," Gastroenterology 138(6):2073-2087 (2010), 30 pages.

Borges et al., "A family of human lymphoid and myeloid Ig-like receptors, some of which bind to MHC class I molecules," J Immunol. 159 (11), 5192-5196 (1997).

Bryceson and Long, "Line of attack: NK cell specificity and integration of signals," Curr Opin Immunol, 20(3), 344-352 (2008), 15 pages.

Carpelan-Holmstrom et al., "Preoperative serum levels of CEA and CA 242 in colorectal cancer," Br J Cancer, 71(4), 868-872 (1995).

Chau et al., "The value of routine serum carcino-embryonic antigen measurement and computed tomography in the surveillance of patients after adjuvant chemotherapy for colorectal cancer," J Clin Oncol 22(8):1420-1429 (2004).

Chaurasiya et al., "Viroimmunotherapy for Colorectal Cancer: Clinical Studies," Biomedicines. Mar. 2017; 5(1):11, 14 pages.

Clarke et al., "Mice transgenic for human carcinoembryonic antigen as a model for immunotherapy," Cancer Res, 58(7), 1469-1477 (1998).

Conaghan et al., "Targeted killing of colorectal cancer cell lines by a humanised IgG1 monoclonal antibody that binds to membrane-bound carcinoembryonic antigen," British Journal of Cancer 98:1217-1225 (2008).

Cong, "Multiplex genome engineering using CRISPR/Cas systems," Science 339: 819-823 (2013), 9 pages.

De Vree et al., "Targeted sequencing by proximity ligation for comprehensive variant detection and local haplotyping," Nat Biotechnol 32(10):1019-1025 (2014), and 2 pages Online Methods.

Doench et al., "Optimized sgRNA design to maximize activity and minimize off-target effects of CRISPR-Cas9," Nat Biotechnol. 34:184-191 (2016), 35 pages.

Durbin et al., "An epitope on carcinoembryonic antigen defined by the clinically relevant antibody PR1A3," Proc. Natl. Acad. Sci. USA pp. 4313-4317, May 1994.

Eades-Perner et al."Mice transgenic for the human carcinoembryonic antigen gene maintain its spatiotemporal expression pattern," Cancer Res, 54(15), 4169-4176 (1994).

Engelhard et al., "Influenza A-specific, HLA-A2.1-restricted cytotoxic T lymphocytes from HLA-A2.1 transgenic mice recognize fragments of the M1 protein," J Immunol, 146(4), 1226-1232 (1991).

(56) References Cited

OTHER PUBLICATIONS

Fedorov et al. "PD-1- and CTLA-4-Based Inhibitory Chimeric Antigen Receptors (iCARs) Divert Off-Target Immunotherapy Responses" Sci. Transl. Med. 5(215):215ra172 25 pages (2013).
Finney et al., "Chimeric Receptors Providing Both Primary and Costimulatory Signaling in T Cells from a Single Gene Product," J Immunol 161, 2791-2797 (1998).
Fu et al., "High-frequency off-target mutagenesis induced by CRISPR-Cas nucleases in human cells," Nat Biotechnol, 31(9), 822-826 (2013), 13 pages.
Garland et al., "The use of Teflon cell culture bags to expand functionally active CD8+ cytotoxic T lymphocytes," J. Immunol Meth. 227(1-2):53-63 (1999).
Gianfrancesco et al., "A nonsynonymous TNFRSF11A variation increases NFκB activity and the severity of Paget's disease," Journal of Bone and Mineral Research 27(2):443-452 (2012).
Haanen et al., "Selective Expansion of Cross-reactive CD8+ Memory T Cells by Viral Variants," J. Exp. Med. 190(9):1319-1328 (1999).
Hamburger et al., "Engineered T cells directed at tumors with defined allelic loss," Molecular Immunology 128:298-310 (2020).
Hofmann & Stoffel, "TMbase—A database of membrane spanning proteins segments," Biol. Chem. Hoppe-Seyler 347:166, 2 pages (1993).
Houston et al., "Protein engineering of antibody binding sites: recovery of specific activity in an anti-digoxin single-chain Fv analogue produced in *Escherichia coli*," Proc. Natl. Acad. Sci. USA 85:5879-5883 (1988).
Hsu et al., "Cytokine-independent growth and clonal expansion of a primary human CD8+ T-cell clone following retroviral transduction with the IL-15 gene," Blood, 109(12), 5168-5177 (2007), 12 pages.
International Search Report and Written Opinion issued by the International Searching Authority for Application No. a PCT/US2021/046774, dated Dec. 8, 2021, 10 pages.
Ji et al., "A modified toxicity probability interval method for dose-finding trials," Clin Trials, 7(6), 653-663 (2010), 21 pages.
Ji et al., "Modified toxicity probability interval design: a safer and more reliable method than the 3+3 design for practical phase I trials," J Clin Oncol, 31(14), 1785-1791 (2013), 12 pages.
Jimenez et al. "Chromosome Loss is the Most Frequent Mechanism Contributing to HLA Haplotype Loss in Human Tumors" Int. J. Cancer 83:91-97 (1999).
Kammerer et al., "Coevolution of activating and inhibitory receptors within mammalian carcinoembryonic antigen families," BMC Biol, 8:12, pp. 1-21. (2010).
Karlin and Atschul, "Applications and statistics for multiple high-scoring segments in molecular sequences," Proc. Natl. Acad. Sci. USA 90:5873-5877 (1993).
Karlin and Atschul, "Methods for assessing the statistical significance of molecular sequence features by using general scoring schemes," Proc. Natl. Acad. Sci. USA 87:2264-2268 (1990).
Katz et al., "Regional CAR-T cell infusions for peritoneal carcinomatosis are superior to systemic delivery," Cancer Gene Ther. May 2016; 23(5): 142-148, 14 pages.
Kersh et al., Structural basis for T cell recognition of altered peptide ligands: a single T cell receptor can productively recognize a large continuum of related ligands. J Exp Med, 184(4), 1259-1268 (1996).
Kloor et al. "Immune evasion of microsatellite unstable colorectal cancers," International Journal of Cancer 127:1001-1010 (2010).
Krogh et al.,"Predicting transmembrane protein topology with a hidden Markov model: application to complete genomes," Journal of Molecular Biology 305(3):567-580 (2001).
Lech et al., "Colorectal cancer tumour markers and biomarkers: Recent therapeutic advances," World J Gastroenterol. Feb. 7, 2016; 22(5): 1745-1755.
Lee et al., "ASTCT Consensus Grading for Cytokine Release Syndrome and Neurologic Toxicity Associated with Immune Effector Cells," Biol Blood Marrow Transplant, 25(4), 625-638 (2019).

MacDonald et al. "Alloantigen-specific regulatory T cells generated with a chimeric antigen receptor" J Clin Invest. (4):1413-1424 (2016).
Marguera et al., Quantitative analysis of fission yeast transcriptomes and proteomes in proliferating and quiescent cells. Cell, 151(3):671-683 (2012).
Marinov et al., "From single-cell to cell-pool transcriptomes: stochasticity in gene expression and RNA splicing," Genome Res. 24(3), 496-510 (2014).
Markowitz et al., "Inactivation of the type II TGF-beta receptor in colon cancer cells with microsatellite instability," Science 268(5215):1336-1338 (1995).
Maude et al., "Tisagenlecleucel in Children and Young Adults with B-Cell Lymphoblastic Leukemia," N Engl J Med, 378(5), 439-448 (2018).
Maus et al. "An MHC-restricted antibody-based chimeric antigen receptor requires TCR-like affinity to maintain antigen specificity" Molecular Therapy—Oncolytics 3(16023) pp. 1-9 (2016).
McEwan et al., Allogeneic CAR-T cell products containing 10 gene edits using CRISPR/Cas9 can retain full functionality in vivo and in vitro American Association for Cancer Research, Philadelphia, 1 page (2020).
McGranahan et al.,"Allele-Specific HLA Loss and Immune Escape in Lung Cancer Evolution," Cell 171:1259-1271 (2017).
Mingoia et al., "Induction of therapeutic levels of HbF in genome-edited primary beta(0) 39-thalassaemia haematopoietic stem and progenitor cells," Br J Haematol. 192:395-404 (2020).
Mizuguchi et al., "Heterozygous TGFBR2 mutations in Marfan syndrome," Nat Gen 36(8):855-860 (2004).
Morgan et al., "Cancer regression and neurological toxicity following anti-MAGE-A3 TCR gene therapy," J Immunother, 36(2), 133-151 (2013), 38 pages.
Mori et al.,"Instabilotyping: comprehensive identification of frameshift mutations caused by coding region microsatellite instability," Cancer Research 61:6046-6049 (2001).
NCBI Reference Sequence: NC_000015.10, Nov. 22, 2021, 3 pages.
NCT02324257, A Study of RO6958688 in Participants With Locally Advanced and/or Metastatic Carcinoembryonic Antigen Positive Solid Tumors, dated Dec. 24, 2014, 12 pages, retrieved online Mar. 31, 2022, from clinicaltrials.gov/ct2/show/NCT02324257.
NCT02650713, A Study of the Safety, Pharmacokinetics, and Therapeutic Activity of RO6958688 in Combination With Atezolizumab in Participants With Locally Advanced and/or Metastatic Carcinoembryonic Antigen (CEA)-Positive Solid Tumors, dated Jan. 8, 2016, 9 pages, retrieved online Mar. 31, 2022, from clinicaltrials.gov/ct2/show/NCT02650713.
NCT02850536, CAR-T Hepatic Artery Infusions or Pancreatic Venous Infusions for CEA-Expressing Liver Metastases or Pancreas Cancer (HITM-SURE), dated Aug. 1, 2016, 8 pages, retrieved online Mar. 31, 2022, from clinicaltrials.gov/ct2/show/NCT02850536.
NCT03682744, CAR-T Intraperitoneal Infusions for CEA-Expressing Adenocarcinoma Peritoneal Metastases or Malignant Ascites (IPC), dated Sep. 25, 2018, 8 pages., retrieved online Mar. 31, 2022, from clinicaltrials.gov/ct2/show/NCT03682744.
NCT03818165, Phase 1b Study of CAR2Anti-CEA CAR-T Cell Hepatic Infusions for Pancreatic Carcinoma Patients With CEA+ Liver Metastases (AntiCEA_CART), dated Jan. 28, 2019, 9 pages, retrieved online Mar. 31, 2022, from clinicaltrials.gov/ct2/show/NCT03818165.
NCT04037241, Study of Anti-CEA CAR-T + Chemotherapy VS Chemotherapy Alone in Patients With CEA+Pancreatic Cancer & Liver Metastases, dated Jul. 30, 2019, 14 pages, retrieved online Mar. 31, 2022, from clinicaltrials.gov/ct2/show/NCT04037241.
NCT04348643, Safety and Efficacy of CEA-Targeted CAR-T Therapy for Relapsed/Refractory CEA+Cancer, dated Apr. 16, 2020, 8 pages, retrieved online Mar. 31, 2022, from clinicaltrials.gov/ct2/show/NCT04348643.
Neelapu et al., Axicabtagene Ciloleucel CAR T-Cell Therapy in Refractory Large B-Cell Lymphoma, N Engl J Med, 377(26):2531-2544 (2017).
Newrzela et al., "Resistance of mature T cells to oncogene transformation," Blood 112(6), 2278-2286 (2008).

(56) References Cited

OTHER PUBLICATIONS

Newrzela et al., "Retroviral insertional mutagenesis can contribute to immortalization of mature T lymphocytes," Mol Med, 17(11-12), 1223-1232 (2011).
Oberst et al.,"CEA/CD3 bispecific antibody MEDI-565/AMG 211 activation of T cells and subsequent killing of human tumors is independent of mutations commonly found in colorectal adenocarcinomas," Mabs Nov.-Dec. 2014; 6(6): 1571-1584.
Parkhurst et al., "Characterization of genetically modified T-cell receptors that recognize the CEA:691-699 peptide in the context of HLA-A2.1 on human colorectal cancer cells,". Clin Cancer Res, 15(1), 169-180 (2009), 23 pages.
Parkhurst et al., "T cells targeting carcinoembryonic antigen can mediate regression of metastatic colorectal cancer but induce severe transient colitis," Mol Ther, 19(3), 620-626 (2011).
Parsons et al., "Microsatellite instability and mutations of the transforming growth factor beta type II receptor gene in colorectal cancer," Cancer Research 55:5548-5550 (1995).
Patton et al., "Evaluation of the efficiency of human immune system reconstitution in NSG mice and NSG mice containing a human HLA.A2 transgene using hematopoietic stem cells purified from different sources," J Immunol Methods 422, 13-21 (2015).
Priestley et al., Pan-cancer whole-genome analyses of metastatic solid tumours, Nature, 575(7781), 210-216 (2019), 24 pages.
Qi et al., "Diversity and clonal selection in the human T-cell repertoire," Proc Natl Acad Sci U S A, 111(36), 13139-13144 (2014).
Qin et al., "Integrin bi-directional signaling: a molecular view," PloS Biol 2:726-729 (2004).
Raje et al.. "Anti-BCMA CAR T-Cell Therapy bb2121 in Relapsed or Refractory Multiple Myeloma," N Engl J Med, 380(18), 1726-1737 (2019), 21 pages.
Ran et al., "Double nicking by RNA-guided CRISPR Cas9 for enhanced genome editing specificity," Cell 154(6), 1380-1389 (2013).
Restifo et al., Adoptive immunotherapy for cancer: harnessing the T cell response. Nat Rev Immunol, 12(4), 269-281 (2012), 30 pages.
Schuster et al., "The immunopeptidomic landscape of ovarian carcinomas," Proc Natl Acad Sci U S A, 114(46), E9942-E9951 (2017).
Schwanhausser et al., "Global quantification of mammalian gene expression control," Nature 473(7347), 337-342 (2011) and Corrigendum, 8 pages.
Shultz et al., "Generation of functional human T-cell subsets with HLA-restricted immune responses in HLA class I expressing NOD/SCID/IL2r gamma(null) humanized mice," Proc Natl Acad Sci U S A, 107(29), 13022-13027 (2010).
Smith et al., "Genome-Wide Analysis of Off-Target CRISPR/Cas9 Activity in Single-Cell-Derived Human Hematopoietic Stem and Progenitor Cell Clones," Genes, 11, pp. 1-16 (2020).
Stewart et al., "Humanisation and characterisation of PR1A3, a monoclonal antibody specific for cell-bound carcinoembryonic antigen," Cancer Immunol. Immunother. 47:299-306 (1999).
Strowig, et al., "Priming of protective T cell responses against virus-induced tumors in mice with human immune system components," J Exp Med, 206(6), 1423-1434 (2009).
Ta et al., Structure-based development of a receptor activator of nuclear factor-kappaB ligand (RANKL) inhibitor peptide and molecular basis for osteopetrosis, (2010) Proc Natl Acad Sci U S A 107: 20281-20286.
Tabernero et al., "Phase Ia and Ib studies of the novel carcinoembryonic antigen (CEA) T-cell bispecific (CEA CD3 TCB) antibody as a single agent and in combination with atezolizumab: Preliminary efficacy and safety in patients with metastatic colorectal cancer (mCRC).," Journal of Clinical Oncology 35, No. 15_suppl (May 20, 2017) 3002-3002, 2 pages.
Teras et al., "2016 US lymphoid malignancy statistics by World Health Organization subtypes," CA Cancer J Clin, 66(6), 443-459 (2016).

Toth-Petroczy et al. Slow protein evolutionary rates are dictated by surface-core association, Proc Natl Acad Sci U S A, 108(27), 11151-11156 (2011).
Tsai, "Dimeric CRISPR RNA-guided FokI nucleases for highly specific genome editing," Nature Biotechnol., 32:6:569-576 (2014), 22 pages.
Ui-Tei et al., "Sensitive assay of RNA interference in *Drosophila* and Chinese hamster cultured cells using firefly luciferase gene as target," FEBS Letters 479:79-82 (2000).
Vakulskas and Behlke, "Evaluation and Reduction of CRISPR Off-Target Cleavage Events," Nucleic Acid Therapeutics 29(4):167-174 (2019).
Veres et al., Low incidence of off-target mutations in individual CRISPR-Cas9 and TALEN targeted human stem cell clones detected by whole-genome sequencing, Cell Stem Cell, 15(1), 27-30 (2014).
Vincent et al., "Mutation analysis of the transforming growth factor-β type II receptor in human cell lines resistant to growth inhibition by transforming growth factor-β," Oncogene 15:117-122 (1997).
Wootton and Federhen, "Statistics of local complexity in amino acid sequences and sequence databases," Computers and Chemistry 17:149-163 (1993).
Xu et al. (2020). Structure- function relationships of chimeric antigen receptors in acute T cell responses to antigen. Mol Immunol, 126, 56-64.
Zhang et al., "Phase I Escalating-Dose Trial of CAR-T Therapy Targeting CEA+ Metastatic Colorectal Cancers," Molecular Therapy 25(5):1248-1258 (2017).
Zhou et al., "Accuracy, Safety, and Reliability of Novel Phase I Trial Designs," Clin Cancer Res, 24(18), 4357-4364 (2018).
European Search Report corresponding to European Patent Application No. 17855171.9, dated Mar. 26, 2020, 8 pages.
International Search Report and Written Opinion issued in International Application No. PCT/US2020/045228, dated Dec. 21, 2020, 17 pages.
International Search Report and Written Opinion issued in International Application No. PCT/US2020/064607, dated Mar. 12, 2021, 11 pages.
International Search Report and Written Opinion received for PCT Application No. PCT/IB2019/001108, dated Jun. 26, 2020, 16 pages.
International Search Report and Written Opinion received for PCT Application No. PCT/IB2020/000710, dated Mar. 18, 2021, 18 pages.
International Search Report and Written Opinion received for PCT Application No. PCT/US2018/053583, dated Feb. 25, 2019, 12 pages.
International Search Report with Written Opinion corresponding to International Patent Application No. PCT/IL2017/051102, dated Jan. 14, 2018, 8 pages.
Abecasis et al. (2010) "A map of human genome variation from population-scale sequencing", Nature—1000 Genomes Project Consortium, 467(7319):1061-1073.
Abeyweera et al. (2011) "Inhibitory signaling blocks activating receptor clustering and induces cytoskeletal retraction in natural killer cells", Journal of Cell Biology, 192(4):675-690.
Auton (2015) "A global reference for human genetic variation", Nature, 526(7571):68-74.
Badran et al. (Dec. 6, 2002) "Identification of Three NFAT Binding Motifs in the 5'-Upstream Region of the Human CD3γ Gene That Differentially Bind NFATc1, NFATc2, and NF-κB p50", The Journal of Biological Chemistry, 277(49):47136-47148.
Barrett et al. (May 1999) "Evolution of neoplastic cell lineages in Barrett oesophagus", Nature genetics, 22(1):106-109.
Bausch-Fluck et al. (Apr. 20, 2015) "A Mass Spectrometric-Derived Cell Surface Protein Atlas", PloS one, 10(4): e0121314.22 pages.
Bayle et al. (Jan. 2006) "Rapamycin analogs with differential binding specificity permit orthogonal control of protein activity", Chemistry & Biology, 13(1):99-107.
Bellon et al. (2002) "Mutational Analysis of Immunoreceptor Tyrosine-Based Inhibition Motifs of the Ig-Like Transcript 2 (CD85j) Leukocyte Receptor", Journal of Immunology, 168(7):3351-3359.

(56) References Cited

OTHER PUBLICATIONS

Bergbold et al. (Dec. 2013) "Emerging role of rhomboid family proteins in mammalian biology and disease", Biochimica et Biophysica Acta (BBA)—Biomembranes, 1828(12):2840-2848.
Betts et al. (2004) "Detection of T-Cell Degranulation: CD107a and b", Methods in Cell Biology, 75:497-512.
Binstadt et al. (Dec. 1996) "Sequential Involvement of Lck And SHP-1 With MHC-Recognizing Receptors on NK ells Inhibits FcR-initiated Tyrosine Kinase Activation", Immunity, 5(6):629-638.
Blankenstein et al. (Apr. 2015) "Targeting cancer-specific mutations by T cell receptor gene therapy", Current opinion in immunology, 33:112-119.
Boczkowski et al. (2000) "Induction of tumor immunity and cytotoxic T lymphocyte responses using dendritic cells transfected with messenger RNA amplified from tumor cells", Cancer Research, 60(4):1028-1034.
Burrell et al. (2013) "The causes and consequences of genetic heterogeneity in cancer evolution", Nature, 501(7467):338-345.
Caescu et al. (Oct. 2009) "Active site determinants of substrate recognition by the metalloproteinases TACE and ADAM10", Biochem J., 424(1):79-88.
Carney et al. (Oct. 1986) "Monoclonal antibody specific for an activated RAS protein", Proceedings of the National Academy of Sciences of the United States of America, 83(19):7485-7489.
Cerami et al. (May 2012) "The cBio cancer genomics portal: an open platform for exploring multidimensional cancer genomics data", Cancer Discovery, 2(5):401-404.
Chao et al. (2006) "Isolating and engineering human antibodies using yeast surface display", Nature Protocols, 1(2):755-768.
Chess Andrew (2012) "Mechanisms and consequences of widespread random monoallelic expression", Nature Reviews Genetics, 13(6):421-428.
Chicaybam et al. (2014) "Construction and validation of an activating and inhibitory chimeric antigen receptor (CAR) system", Cancer Research, Abstract 2797, 74(15):2 pages.
Chicaybam et al. (2015) "Construction and validation of an activating and inhibitory chimeric antigen receptor (CAR) system", Cancer Research, Abstract 3156, 75(15):2 pages.
Compagno et al. (Jun. 2009) "Mutations of multiple genes cause deregulation of NF-kappaB in diffuse large B-cell lymphoma", Nature, 459(7247):717-721(13 pages).
Cordoba et al. (May 23, 2013) "The large ectodomains of CD45 and CD148 regulate their segregation from and inhibition of ligated T-cell receptor", Blood, 121(21):4295-4302.
Da Cunha et al. (2009) "Bioinformatics construction of the human cell surfaceome", Proceedings of the National Academy of Sciences of the United States of America, 106(39):16752-16757.
Devilee et al. (2001) "Ever since Knudson", Trends in genetics, 17(10):569-573.
Dotti et al. (Jan. 2014) "Design and Development of Therapies using Chimeric Antigen Receptor-Expressing T cells", Immunological Reviews, 257(1):107-126.
Ebsen et al. (Oct. 9, 2013) "Differential Surface Expression of ADAM10 and ADAM17 on Human T Lymphocytes and Tumor Cells", PloS one, 8(10):e76853:16 pages.
Ellis et al. (Mar. 2000) "Frequencies of HLA-A2 alleles in five U.S. population groups Predominance of A* 02011 and identification of HLA-A* 0231", Human Immunology, 61(3):334-340.
Eriksson et al. (Oct. 4, 1999) "Inhibitory receptors alter natural killer cell interactions with target cells yet allow simultaneous killing of susceptible targets", The Journal of Experimental Medicine, 190():1005-1012.
Feenstra et al. (1999) "HLA class I expression and chromosomal deletions at 6p and 15q in head and neck squamous cell carcinomas", Tissue antigens, 54(3):235-245.
Gao et al. (2013) "Integrative Analysis of Complex Cancer Genomics and Clinical Profiles Using the cBioPortal", Sci Signal., 6(269):1-34.

Gerlinger et al. (2012) "Intratumor Heterogeneity and Branched Evolution Revealed by Multiregion Sequencing", New England Journal of Medicine, 366(10):883-892.
Gill et al. (Jan. 2015) "Going Viral: Chimeric Antigen Receptor T-Cell Therapy for Hematological Malignancies", Immunological Reviews, 263(1):68-89.
Gordon et al. (Jun. 22, 2015) "Mechanical Allostery: Evidence for a Force Requirement in the Proteolytic Activation of Notch", Developmental Cell, 33(6):729-736(20 pages).
Graef et al. (1997) "Proximity and orientation underlie signaling by the non-receptor tyrosine kinase ZAP70", The EMBO, 16(18):5618-5628.
Gross et al. (Dec. 1989) "Expression of immunoglobulin-T-cell receptor chimeric molecules as functional receptors with antibody-type specificity", Proc. Natl. Acad. Sci. USA, 86(24):10024-10028.
Gross et al. (2016) "Therapeutic Potential of T Cell Chimeric Antigen Receptors (CARs) in Cancer Treatment: Counteracting Off-Tumor Toxicities for Safe CAR T Cell Therapy", Annual Review of Pharmacology and Toxicology, 56:59-83.
GTEX Consortium (2015) "The Genotype-Tissue Expression (GTEx) pilot analysis Multitissue gene regulation in humans", Science, 348(6235):648-660(33 pages).
Gustafson et al. (2017) "Immune Checkpoint Function of CD85j in CD8 T Cell Differentiation and Aging", Frontiers in Immunology, 8(692)1-12.
Haapasalo et al. (2011) "The Many Substrates of Presenilin/γ-Secretase", Journal of Alzheimer's disease, 25(1):3-28.
Hanes et al. (May 1997) "In Vitro Selection and Evolution of Functional Proteins by Using Ribosome Display", Proceedings of the National Academy of Sciences, 94(10):4937-4942.
Heemskerk et al. (2013) "The cancer antigenome", The EMBO journal, 32(2):194-203.
Hemming et al. (Dec. 29, 2009) "Identification of β-Secretase (BACE1) Substrates Using Quantitative Proteomics", PLoS ONE, 4(12):e8477. pp. 1-14.
Hilton et al. (Apr. 2013) "Direct binding to antigen-coated beads refines the specificity and cross-reactivity of four monoclonal antibodies that recognize polymorphic epitopes of HLA class I molecules", Tissue Antigens, 81(4):212-220.
Huse et al. (2013) "Building tolerance by dismantling synapses: inhibitory receptor signaling in natural killer cells", Immunological reviews, 251(1):143-153.
Hwang et al. (Mar. 17, 2021) "Targeting loss of heterozygosity for cancer-specific immunotherapy", PNAS, 118(12)e2022410118:1-10 pages.
Irles et al. (2003) "CD45 ectodomain controls interaction with GEMs and Lek activity for optimal TCR signaling", Nature Immunology, 4:189-197.
Klebanoff et al. (2016) "Prospects for gene-engineered T cell immunotherapy for solid cancers", Nature medicine, 22(1):26-36(25 pages).
Kloss et al. (2013) "Combinatorial antigen recognition with balanced signaling promotes selective tumor eradication by engineered T cells", Nature biotechnology, 31(1):71-75(15 pages).
Knudson et al. (1971) "Mutation and cancer: statistical study of retinoblastoma", Proceedings of the National Academy of Sciences, 68(4):820-823.
Lanitis et al. (2013) "Chimeric antigen receptor T cells with dissociated signaling domains exhibit focused anti-tumor activity with reduced potential for toxicity in vivo", Cancer immunology research, 1(1):43-53(20 pages).
Lawrence et al. (2014) "Discovery and saturation analysis of cancer genes across 21 tumor types", Nature, 505(7484): 495-501(22 pages).
Lawrence et al. (2013) "Mutational heterogeneity in cancer and the search for new cancer-associated genes", Nature, 499(7457):214-218(12 pages).
Lee et al. (Mar. 2003) "Distribution analysis of nonsynonymous polymorphisms within the G-protein-coupled receptor gene family", Genomics, 81(3):245-248.
Lek et al. (2016) "Analysis of protein-coding genetic variation in 60,706 Humans", Nature, 536(7616):285-291 (33 pages).

(56) References Cited

OTHER PUBLICATIONS

Lengauer et al. (1998) "Genetic Instabilities in Human Cancers", Nature, 396(6712):643-649.
Leung et al. (2019) "Sensitive and adaptable pharmacological control of CAR T cells through extracellular receptor dimerization", JCI Insight, 4(11):e124430(19 pages).
Li et al. (2014) "A Preliminary Study of the Relationship Between Breast Cancer Metastasis and Loss of Heterozygosity by Using Exome Sequencing", Scientific Reports, 4:5460(1-6).
Li et al. (Mar. 2020) "LILRB4 ITIMs mediate the T cell suppression and infiltration of acute myeloid leukemia cells", Cellular & Molecular Immunology, 17(3):272-282.
Liberles et al. (Jul. 1997) "Inducible Gene Expression and Protein Translocation Using Nontoxic Ligands Identified by a Mammalian Three-hybrid Screen", Proceedings of the National Academy of Sciences, 94(15):7825-7830.
Lindblad-Toh et al. (2000) "Loss-of-heterozygosity Analysis of Small-cell Lung Carcinomas Using Single-nucleotide Polymorphism Arrays", Nature Biotechnology, 18(9):1001-1005.
Lo et al. (2008) "Comprehensive analysis of loss of heterozygosity events in glioblastoma using the 100K SNP mapping arrays and comparison with copy number abnormalities defined by BAC array comparative genomic hybridization", Genes Chromosomes Cancer, 47(3):221-237.
Long et al. (2013) "Controlling NK Cell Responses: Integration of Signals for Activation and Inhibition", Annual Review of Immunology, 31:227-258(36 pages).
Maleno et al. (2004) "Distribution of HLA class I altered phenotypes in colorectal carcinomas: high frequency of HLA haplotype loss associated with loss of heterozygosity in chromosome region 6p21", Immunogenetics, 56(4):244-253.
Maleno et al. (2010) "Frequent loss of heterozygosity in the β2-microglobulin region of chromosome 15 in primary human tumors", Immunogenetics, 63(2):65-71.
Maleno et al. (2006) "LOH at 6p21.3 region and HLA class altered phenotypes in bladder carcinomas", Immunogenetics, 58(7):503-510.
Maleno et al. (2002) "Multiple mechanisms generate HLA class I altered phenotypes in laryngeal carcinomas: high frequency of HLA haplotype loss associated with loss of heterozygosity in chromosome region 6p21", Cancer Immunology, Immunotherapy, 51(7):389-396.
Mcevoy et al. (2002) "Frequency and Genetic Basis of MHC, beta-2-microglobulin and MEMO-1 Loss of Heterozygosity in Sporadic Breast Cancer", Tissue Antigens, 60(3):235-243.
Mcgranahan et al. (2012) "Cancer Chromosomal Instability: Therapeutic and Diagnostic Challenges", EMBO reports, 13(6):528-538.
Medintz et al. (2000) "Loss of Heterozygosity Assay for Molecular Detection of Cancer Using Energy-transfer Primers and Capillary Array Electrophoresis", Genome Research, 10(8):1211-1218.
Morgan et al. (Apr. 2010) "Case Report of a Serious Adverse Event Following the Administration of T Cells Transduced With a Chimeric Antigen Receptor Recognizing ERBB2", Molecular Therapy, 18(4):843-851.
Morsut et al. (Feb. 11, 2016) "Engineering Customized Cell Sensing and Response Behaviors Using Synthetic Notch Receptors", Cell, 164(4):780-791.
Ng et al. (2003) "SIFT: Predicting Amino Acid Changes that Affect Protein Function", Nucleic Acids Research, 31(13):3812-3814.
Nirschl et al. (Sep. 15, 2013) "Molecular Pathways: Coexpression of Immune Checkpoint Molecules: Signaling Pathways and Implications for Cancer Immunotherapy", Clinical Cancer Research, 19(18):4917-4924.
Ohgaki et al. (Oct. 1, 2004) "Genetic Pathways to Glioblastoma A Population-Based Study", Cancer Research, 64(19):6892-6899.
O'Keefe et al. (2010) "Copy Neutral Loss of Heterozygosity: A Novel Chromosomal Lesion in Myeloid Malignancies", Blood, 115(14):2731-2739.
Overwijk et al. (2013) "Mining the Mutanome: Developing Highly Personalized Immunotherapies Based on Mutational Analysis of Tumors", Journal for ImmunoTherapy of Cancer, 1:11(1-4).
Patel et al. (2014) "Cancer CARtography: Charting Out a New Approach to Cancer Immunotherapy", Immunotherapy, 6(6):675-678(6 pages).
Ramos et al. (Jun. 2015) "Molecular Biology Techniques for Loss of Heterozygosity Detection: The Glioma Example", Jornal Brasileiro de Patologia e Medicina Laboratorial, 51(3):189-196.
Rana et al. (2001) "Genetic Variations and Polymorphisms of G Protein-coupled Receptors: Functional and Therapeutic Implications", Annual Review of Pharmacology and Toxicology, 41(1):593-624.
Rawson Robert B. (2013) "The Site-2 Protease", Biochimica et Biophysica Acta (BBA)—Biomembranes, 1828(12):2801-2807.
Rosenberg et al. (2015) "Adoptive Cell Transfer as Personalized Immunotherapy for Human Cancer", Science, 348(6230):62-68.
Rosenberg Steven A. (2014) "Finding Suitable Targets is the Major Obstacle to Cancer Gene Therapy", Cancer Gene Therapy, 21:45-47.
Roybal et al. (Feb. 11, 2016) "Precision Tumor Recognition by T Cells With Combinatorial Antigen-Sensing Circuits", Cell, 164:770-779.
Sathirapongsasuti et al. (2011) "Exome Sequencing-based Copy-number Variation and Loss of Heterozygosity Detection: ExomeCNV", Bioinformatics, 27(19):2648-2654.
Savage Peter A. (2014) "Tumor Antigenicity Revealed", Trends in immunology, 35(2):47-48(3 pages).
Savova et al. (2016) "Genes with Monoallelic Expression Contribute Disproportionately to Genetic Diversity in Humans", Nature Genetics, 48(3):231-237(25 pages).
Sayós et al. (2004) "Recruitment of C-Terminal Src Kinase by the Leukocyte Inhibitory Receptor CD85j", Biochemical and Biophysical Research Communications, 324(2):640-647.
Schumacher et al. (Apr. 3, 2015) "Neoantigens in Cancer Immunotherapy", Science, 348(6230):69-74.
Sela-Culang et al. (Apr. 2015) "Antibody Specific Epitope Prediction—emergence of a New Paradigm", Current opinion in virology,11:98-102.
Sela-Culang et al. (Apr. 15, 2015) "PEASE: predicting B-cell epitopes utilizing antibody sequence", Bioinformatics, 31(8):1313-1315.
Sergeeva et al. (2008) "Direct Visualization of PR1/HLA-A2 on the Membrane of HLAA2+ CD13+CD33+ Myeloid Leukemia Blasts by a Novel Monoclonal Antibody", Blood, 112(11):2545(2 pages).
Skora et al. (Aug. 11, 2015) "Generation of MANAbodies Specific to HLA-Restricted Epitopes Encoded by Somatically Mutated Genes", Proceedings of the National Academy of Sciences, 112(32):9967-9972.
Spierings E (Aug. 31, 2008) "Minor histocompatibility antigens: targets for tumour therapy and transplant tolerance", International Journal of Immunogenetics, 35(4-5):363-366.
Stark et al. (Sep. 1, 1991) "Antibodies that are specific for a single Amino Acid Interchange in a Protein Epitope Use structurally Distinct Variable Regions", The Journal of Experimental Medicine, 174(3):613-624.
Stark, et al. (Mar. 15, 2007) "Genome-Wide Loss of Heterozygosity and Copy Number Analysis in Melanoma using High-Density Single-Nucleotide Polymorphism Arrays", Cancer Research, 67(6):2632-2642.
Zack et al. (Oct. 2013) "Pan-cancer Patterns of Somatic Copy Number Alteration", Nature Genetics, 45(10):1134-1140.
Sun et al. (2014) "Construction and Evaluation of a Novel Humanized HER2-specific Chimeric Receptor", Breast Cancer Research, 16:R61(10 pages).
Tait et al. (Mar. 31, 2001) "Clinical relevance of the minor histocompatibility antigen HA-1 in allogeneic bone marrow transplantation between HLA identical siblings", Transplantation Proceedings, 33(1-2):1760-1761.
Teo et al. (Nov. 1, 2012) "Statistical challenges associated with detecting copy number variations with next-generation sequencing", Bioinformatics, 28(21):2711-2718.

(56) References Cited

OTHER PUBLICATIONS

Thul et al. (May 26, 2017) "A Subcellular Map of the Human Proteome", Science, 356(6340):eaal3321(14 pages).
Treanor et al. (Jul. 3, 2006) "Microclusters of Inhibitory Killer Immunoglobulin-like Receptor Signaling at Natural Killer Cell Immunological Synapses", The Journal of cell biology, 174(1):153-161.
Uhlen et al. (Jan. 23, 2015) "Tissue-based Map of the Human Proteome", Science, 347(6220):1260419(11 pages).
Zheng et al. (May 9, 2016) "Comprehensive Pan-Genomic Characterization of Adrenocortical Carcinoma", Cancer Cell, 29(5):723-736.
Van Buuren et al. (May 14, 2014) "High Sensitivity of Cancer Exome-Based CD8 T Cell Neo-Antigen Identification", Oncoimmunology, 3:e28836(6 pages).
Vogelstein et al. (Apr. 14, 1989) "Allelotype of Colorectal Carcinomas", Science, 244(4901):207-211.
Vogelstein et al. (Mar. 29, 2013) "Cancer Genome Landscapes", Science, 339(6127):1546-1558.
Voss et al. (Dec. 2013) "Mechanism, Specificity, and Physiology of Signal Peptide Peptidase (SPP) and SPP-like Proteases", Biochimica Et Biophysica Acta (BBA)—Biomembranes, 1828(12):2828-2839.
Vyas et al. (Oct. 15, 2001) "Spatial organization of signal transduction molecules in the NK cell immune synapses during MHC class I-regulated noncytolytic and cytolytic interactions", The Journal of immunology, 167(8):4358-4367.
Walseng et al. (Sep. 6, 2017) "A TCR-based Chimeric Antigen Receptor", Scientific Reports, 7(1):10 pages.
Wang et al. (Jan. 1, 2004) "Loss of heterozygosity and its Correlation with Expression Profiles in Subclasses of Invasive Breast Cancers", Cancer research, 64(1):64-71.
Wilkie et al. (Oct. 2012) "Dual targeting of ErbB2 and MUC1 in breast cancer using chimeric antigen receptors engineered to provide complementary signaling", Journal of Clinical Immunology, 32(5):1059-1070.
Wu et al. (Oct. 16, 2015) "Remote Control of Therapeutic T Cells Through a Small Molecule-Gated Chimeric Receptor", Science, 350(6258):aab4077(21 pages).
Yeung et al. (Apr. 1, 2013) "LOH in the HLA class I region at 6p21 is Associated with Shorter Survival in Newly Diagnosed Adult Glioblastoma", Clinical Cancer Research, 19(7):1816-1826.
Ren et al. (May 1, 2017) "Multiplex genome editing to generate universal CAR T cells resistant to PD1 inhibition", Clinical Cancer Research, 23(9): 2255-2266.
Pennisi, Elizabeth (Aug. 2013) "The CRISPR craze", Science, 341(6148):833-836.
NCBI Reference Sequence: NP_000738.2, retrieved from web Jun. 8, 2022, 4 pages.
NCBI Reference Sequence: NP_002199.3, retrieved from web Jun. 8, 2022, 5 pages.
NCBI Reference Sequence: NP_003684.2, retrieved from web Jun. 8, 2022, 4 pages.
NCBI Reference Sequence: NP_003830.1, retrieved from web Jun. 8, 2022, 3 pages.
NCBI Reference Sequence: NP_569057.2, retrieved from web Jun. 8, 2022, 4 pages.
NCBI Reference Sequence: NP_001094282.1, retrieved from web Jun. 8, 2022, 3 pages.
NCBI Reference Sequence: NP_001278413.1, retrieved from web Jun. 8, 2022, 8 pages.
NCBI Reference Sequence: NP_001295327.1, retrieved from web Jun. 8, 2022, 7 pages.

* cited by examiner

FIG. 4

| Cancer (% CEA+; median >100 transcripts/cell) | Patient No. | RANK LOH Freq. | Treatable No. Range (CEA+) [MAF = 0.1 – 0.4] | NGS Dx: pass/tested [MAF = 0.1 – 0.4] |
|---|---|---|---|---|
| Rectal (100%) [30% subset of colorectal] | 15K | 0.87 | 0.8-1.6K | 2 × [0.05 – 0.11] = [1/10 – 1/5] |
| Colorectal (100%) | 53K | 0.70 | 2-5K | 2 × [0.04- 0.09] = [1/12 – 1/6] |
| Pancreatic (50%) | 43K | 0.67 | 0.8-2.0K | 2 × [0.04- 0.09] |
| Esophagael (50%) | 16K | 0.63 | 0.3-0.7K | 2 × [0.03 – 0.08] |
| Gastric (50%) | 11K | 0.47 | 0.2-0.3K | 2 × [0.03 - 0.06] |
| Lung adenocarcinoma (50%) | 109K | 0.47 | 1.5-3K | 2 × [0.03 - 0.06] = [1/20 – 1/9] |
| Head&Neck | | 0.53 | | |
| DLBCL | | 0.04 | | |
| AML | | 0.02 | | |
| All cancers | | 0.33 | | |

FIG. 9

| CANCER TYPE | DEATHS |
|---|---|
| Lung and bronchus | 155,870 |
| Colorectum | 50,260 |
| Pancreas | 43,090 |
| Breast | 41,070 |
| Liver and intrahepatic bile duct | 28,920 |
| Prostate | 26,730 |
| Leukemia | 24,500 |
| Non-Hodgkin lymphoma | 20,140 |
| Urinary bladder | 16,870 |
| Brain and other nervous system | 16,700 |
| Esophagus | 15,690 |
| Kidney and renal pelvis | 14,400 |
| Ovary | 14,080 |
| Myeloma | 12,590 |
| Stomach | 10,960 |
| Uterine corpus | 10,920 |

| CANCER TYPE | DEATHS |
|---|---|
| Melanoma of the skin | 9,730 |
| Oral cavity and pharynx | 9,700 |
| Soft tissue (including heart) | 4,990 |
| Cervix | 4,210 |
| Gallbladder and other biliary | 3,830 |
| Larynx | 3,660 |
| Thyroid | 2,010 |
| Bones and joints | 1,550 |
| Small intestine | 1,390 |
| Vagina and other female genital | 1,240 |
| Vulva | 1,150 |
| Anus, anal canal and anorectum | 1,100 |
| Hodgkin lymphoma | 1,070 |
| Ureter and other urinary organs | 920 |
| Testis | 410 |
| Penis and other male genital | 360 |

FIG. 12
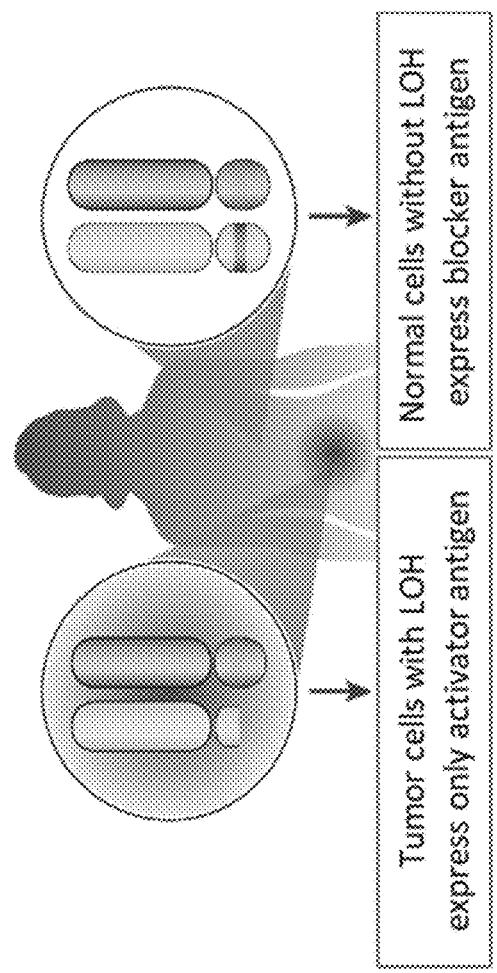
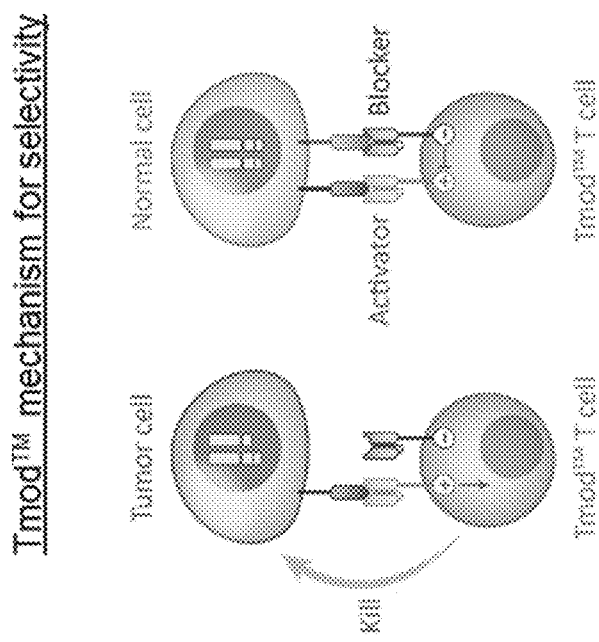

FIG. 18
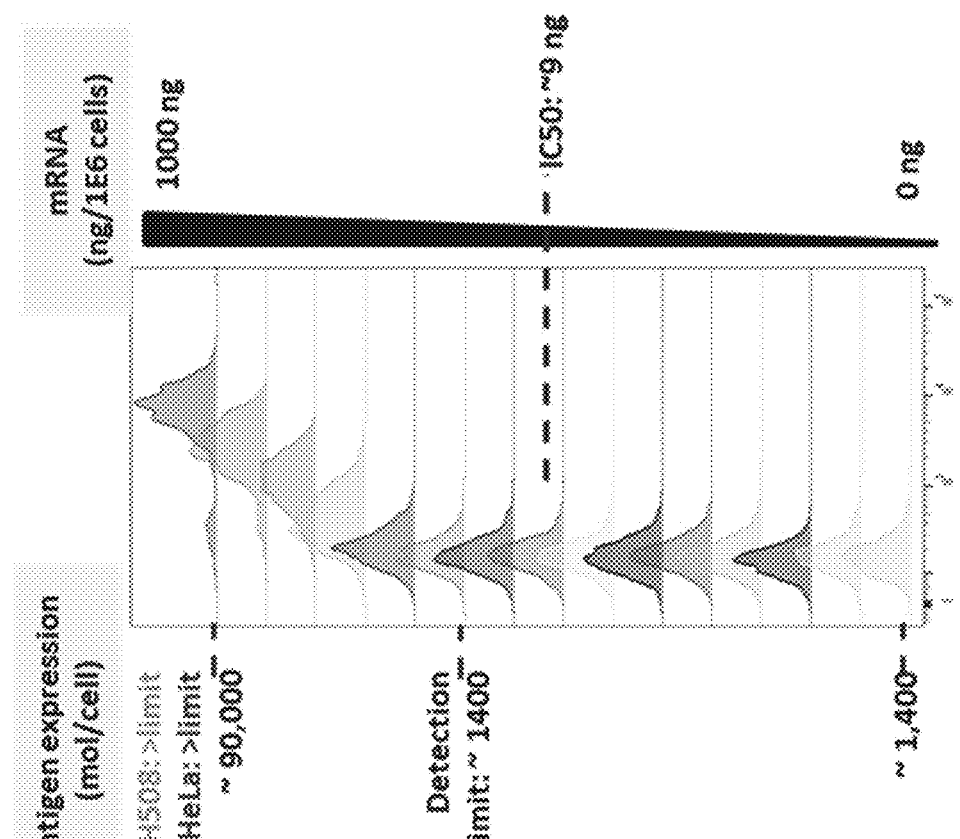
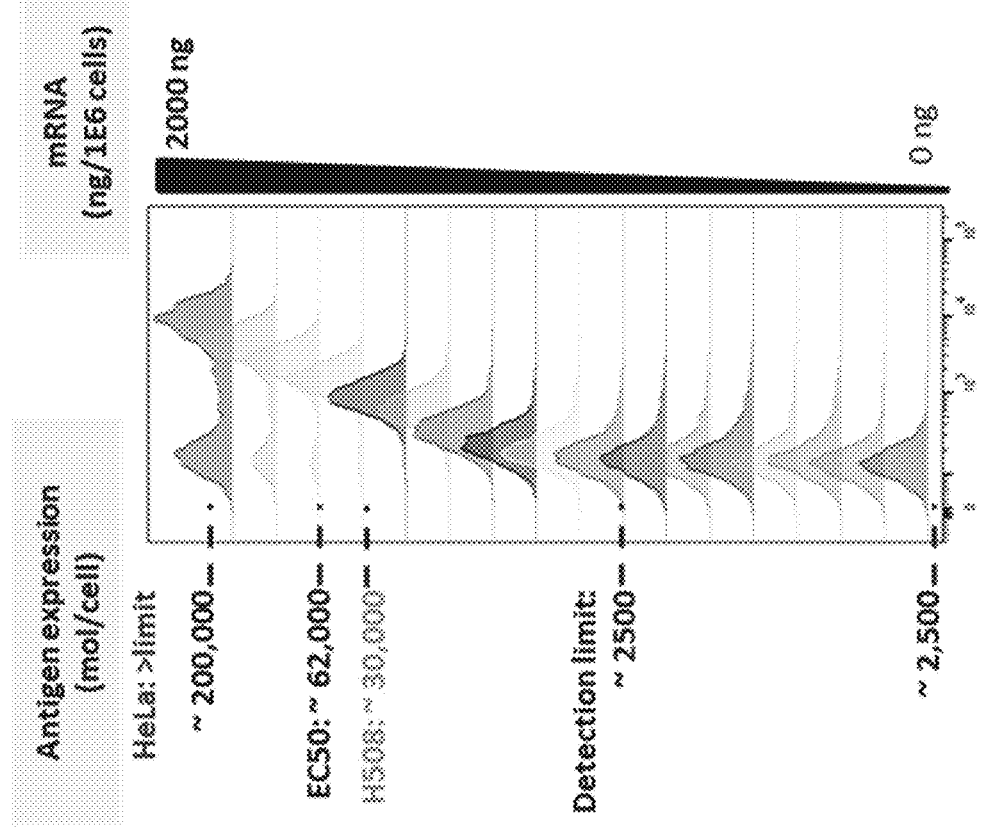

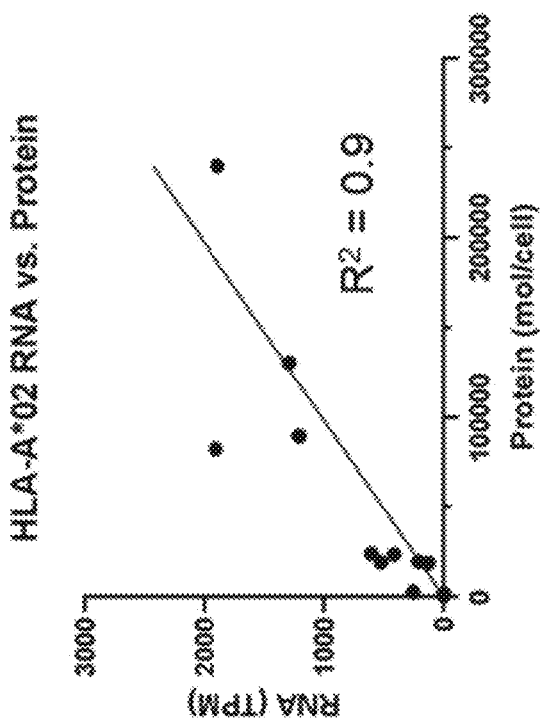
FIG. 22
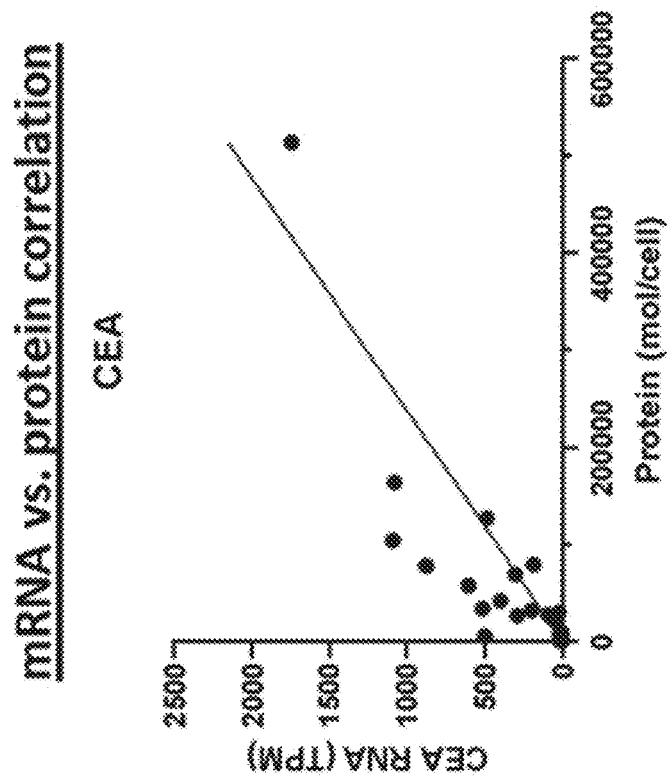

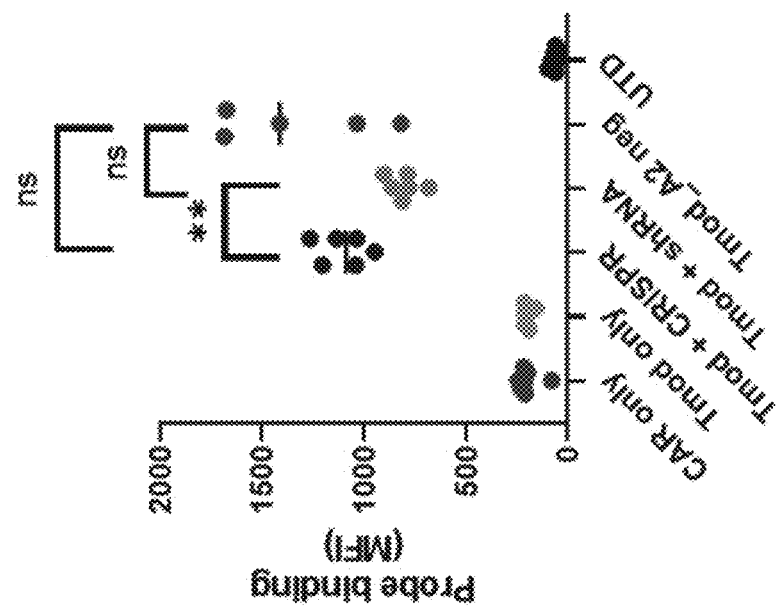
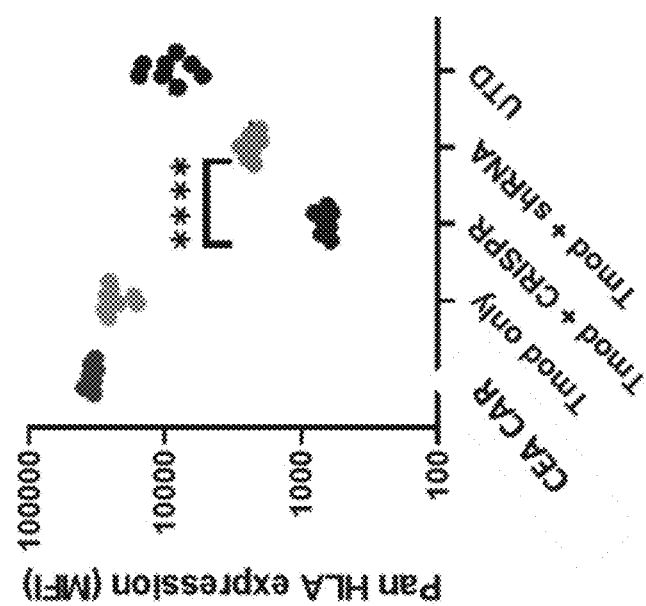
FIG. 47

FIG. 50
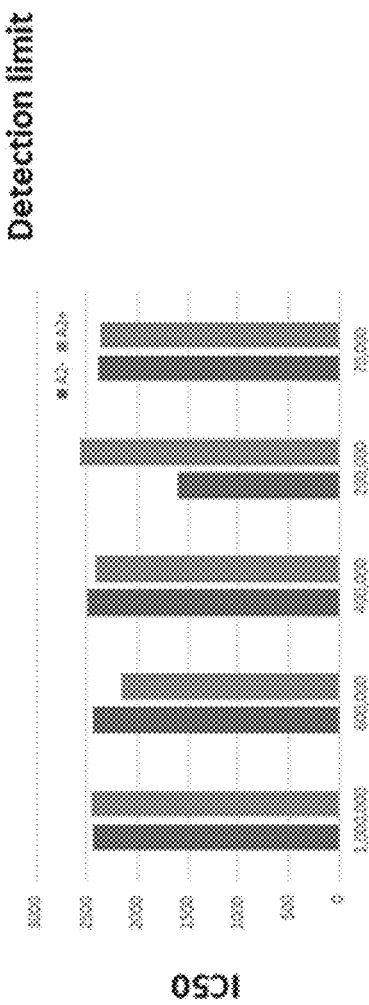
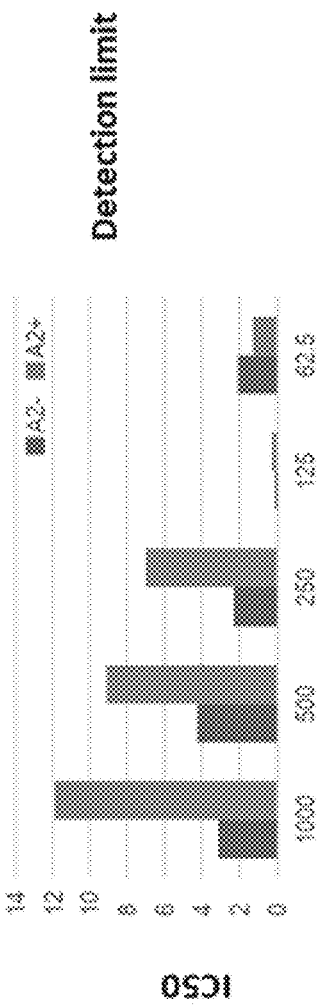
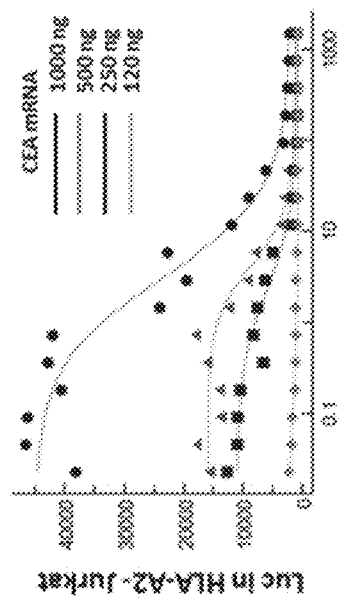
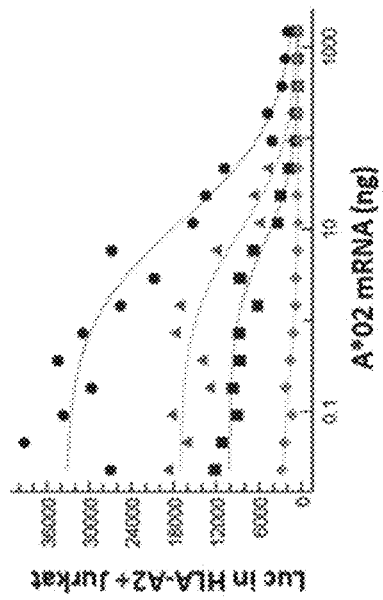

FIG. 53

| CEA CAR Tmod properties | Supporting data |
|---|---|
| High on-target, off-tumor selectivity | • CEA CAR Tmod (CEA CAR paired with an HLA-A*02-specific blocker receptor) has >10x selectivity for CEA(+)/A*02(-) tumor cells relative to CEA(+)/A*02(+) normal cells<br>• Comparable to TCR-T cells in cytotoxicity assays<br>• Selectivity confirmed in mouse xenograft experiments |
| High potency | • CEA CAR Tmod cells specifically kill a tumor cell line with native CEA and HLA-A*02 expression<br>• Similar potency to a benchmark clinical CEA TCR |
| Reversible activity | • CEA CAR Tmod cell activation is reversible in vitro, cycling between ON and OFF states |
| No inhibition from soluble CEA | • in vitro, CEA CAR Tmod cells are not inhibited by elevated levels of sCEA |
| Suitable for allogeneic or autologous | • With shRNA expression module, CEA CAR Tmod dual receptors function equivalently in HLA-A*02(+) and HLA-A*02(-) donor T cells |

COMPOSITIONS AND METHODS FOR TREATING CEACAM POSITIVE CANCERS

RELATED APPLICATIONS

This application is a continuation of International Application No. PCT/US2021/046774, filed on Aug. 19, 2021, which claims priority to, and benefit of, U.S. Provisional Application No. 63/068,244, filed on Aug. 20, 2020, the contents of which are incorporated by reference herein.

TECHNICAL FIELD

The disclosure relates to the fields of adoptive cell therapy and cancer therapeutics.

INCORPORATION BY REFERENCE OF SEQUENCE LISTING

This application contains a Sequence Listing which has been submitted in ASCII format via EFS-WEB and is hereby incorporated by reference in its entirety. Said ASCII copy, created on Nov. 2, 2021 is named A2BI_022_01US_SeqList_ST25.txt and is 914 KB in size.

BACKGROUND

Cell therapy is a powerful tool for the treatment of various diseases, particularly cancers. In conventional adoptive cell therapies, immune cells are engineered to express specific receptors, for example chimeric antigen receptors (CARs) or T cell receptors (TCRs), which direct the activity of the immune cells to cellular targets via interaction of the receptor with a ligand expressed by the target cell. Identification of suitable target molecules remains challenging, as many targets are expressed in normal tissues. This expression can lead to toxicity when the transplanted cells target normal tissues expressing target molecules. There is thus a need in the art for compositions and methods useful in the treatment of disease, particularly cancers, by adoptive cell therapy.

SUMMARY

The disclosure provides compositions and methods for increasing the specificity of immune cells used in adoptive cell therapy. The disclosure provides immune cells comprising a two-receptor system that increases the specificity of the immune cells for target cells expressing a target antigen. The immune cells comprise a first, activator receptor that activates the immune cells in response to binding of the first receptor by the target antigen. The immune cells further comprise a second, inhibitory receptor specific to a non-target antigen. This second receptor inhibits activation of the immune cells when the second receptor is bound by the non-target antigen, even when the first receptor is bound by the target antigen.

The disclosure provides an immune cell comprising: (a) a first receptor, comprising an extracellular ligand binding domain specific to CEA cell adhesion molecule 5 (CEA); and (b) a second receptor, comprising an extracellular ligand binding domain specific to a non-target antigen lost in a CEA+ cancer cell, wherein the first receptor is an activator receptor responsive to CEA; and wherein the second receptor is an inhibitory receptor responsive to the non-target antigen.

In some embodiments of the immune cells of the disclosure, the non-target antigen is lost in the CEA+ cancer cell through loss of heterozygosity.

In some embodiments of the immune cells of the disclosure, the extracellular ligand binding domain of the second receptor specifically binds an allelic variant of a major histocompatibility complex (MHC) protein. In some embodiments, the extracellular ligand binding domain of the second receptor specifically binds an allelic variant of an HLA-A, HLA-B, or HLA-C protein. In some embodiments, the extracellular ligand binding domain of the second receptor specifically binds to HLA-A*01, HLA-A*02, HLA-A*03, HLA-A*11, HLA-1B*07, or HLA-C*07. In some embodiments, the extracellular ligand binding domain of the second receptor specifically binds to HLA-A*02. In some embodiments, the extracellular ligand binding domain of the second receptor comprises complementarity determining regions (CDRs) CDR-L1, CDR-L2, CDR-L3, CDR-H1, CDR-H2, CDR-H3 as disclosed Table 6; or CDR sequences having at most 1, 2, or 3 substitutions, deletions, or insertions relative to the CDRs of Table 6. In some embodiments, the extracellular ligand binding domain of the second receptor comprises complementarity determining regions (CDRs) CDR-L1, CDR-L2, CDR-L3, CDR-H1, CDR-H2, CDR-H3 of SEQ ID NOS: 103-108 or of SEQ ID NOS: 109-114; or CDR sequences having at most 1, 2, or 3 substitutions, deletions, or insertions relative to the CDRs of SEQ ID NOS: 103-108 or SEQ ID NOS: 109-114. In some embodiments, the extracellular ligand binding domain of the second receptor comprises a polypeptide sequence selected from the polypeptide sequence disclosed in Table 5; or a sequence having at least 85%, at least 90%, at least 95%, at least 97% or at least 99% identity thereto. In some embodiments, the extracellular ligand binding domain of the second receptor comprises any one of SEQ ID NOS: 91-102, or a sequence having at least 85%, at least 90%, at least 95%, at least 97% or at least 99% identity thereto.

In some embodiments of the immune cells of the disclosure, the first receptor is a chimeric antigen receptor (CAR). In some embodiments, the extracellular ligand binding domain of the first receptor comprises a variable heavy (VH) portion comprising a set of heavy chain complementarity determining regions (HC-CDRs) selected from the group consisting of SEQ ID NOS: 55-58 and a variable light (VL) portion comprising a set of light chain complementarity determining regions selected from the group consisting of SEQ ID NOS: 59-63; or CDR sequences having at most 1, 2, or 3 substitutions, deletions, or insertions relative to SEQ ID NOS: 55-58 or SEQ ID NOS: 59-63. In some embodiments, the extracellular ligand binding domain of the first receptor comprises a variable heavy (VH) portion comprising a set of heavy chain complementarity determining regions (HC-CDRs) comprising SEQ ID NOS: 55-57 and a variable light (VL) portion comprising a set of light chain complementarity determining regions comprising SEQ ID NOS: 59, 61 and 63; or CDR sequences having at most 1, 2, or 3 substitutions, deletions, or insertions relative to SEQ ID NOS: 55-57 or SEQ ID NOS: 59, 61 and 63. In some embodiments, the extracellular ligand binding domain of the first receptor comprises a variable heavy (VH) portion comprising SEQ ID NO: 144 or a sequence having at least 85%, at least 90%, at least 95%, at least 97%, or at least 99% identity thereto, and a variable light (VL) portion comprising SEQ ID NO: 148 or a sequence having 85%, at least 90%, at least 95%, at least 97%, or at least 99% identity thereto. In some embodiments, the extracellular ligand binding domain of the first receptor comprises a sequence selected from the group consisting of SEQ ID NOS: 66-70, or a sequence having at least 85%, at least 90%, at least 95%, at least 97%, or at least 99% identity thereto. In some embodiments, the extracellular ligand binding domain of the first receptor comprises an scFv sequence of SEQ ID NO: 68; or a sequence having at least 85%, at least 90%, at least 95%, at least 97% or at least 99% identity thereto.

In some embodiments of the immune cells of the disclosure, the first receptor is a chimeric antigen receptor (CAR). In some embodiments, the first receptor comprises a hinge domain, a transmembrane domain and an intracellular domain. In some embodiments, the hinge domain comprises a CD8α hinge domain. In some embodiments, the CD8α hinge domain comprises a sequence of SEQ ID NO: 71, or a sequence having at least 85%, at least 90%, at least 95%, at least 97% or at least 99% identity thereto. In some embodiments, the transmembrane domain comprises a CD28 transmembrane domain. In some embodiments, the CD28 transmembrane domain comprises a sequence of SEQ ID NO: 75, or a sequence having at least 85%, at least 90%, at least 95%, at least 97% or at least 99% identity thereto. In some embodiments, the intracellular domain comprises a CD28 co-stimulatory domain, a 4-1BB co-stimulatory domain, and a CD3ζ activation domain. In some embodiments, the intracellular domain comprises a sequence of SEQ ID NO: 158, or a sequence having at least 85%, at least 90%, at least 95%, at least 97% or at least 99% identity thereto.

In some embodiments of the immune cells of the disclosure, the first receptor comprises a sequence of SEQ ID NO: 52, or a sequence having at least 90%, at least 95%, at least 97% or at least 99% identity thereto.

In some embodiments of the immune cells of the disclosure, the second receptor comprises a LILRB1 intracellular domain or a functional variant thereof. In some embodiments, the LILRB1 intracellular domain comprises a sequence at least 90%, at least 95%, at least 97%, at least 99%, or is identical to SEQ ID NO: 131. In some embodiments, the second receptor comprises a LILRB1 transmembrane domain or a functional variant thereof. In some embodiments, the LILRB1 transmembrane domain or a functional variant thereof comprises a sequence at least 90%, at least 95%, at least 97%, at least 99% or is identical to SEQ ID NO: 135. In some embodiments, the second receptor comprises a LILRB1 hinge domain or functional variant thereof. In some embodiments, the LILRB1 hinge domain comprises a sequence at least 90%, at least 95%, at least 97%, at least 99% or is identical to SEQ ID NO: 134. In some embodiments, the second receptor comprises a LILRB1 intracellular domain, a LILRB1 transmembrane domain, a LILRB1 hinge domain, a functional variant of any of these, or combinations thereof. In some embodiments, the LILRB1 hinge domain, LILRB1 intracellular domain and LILRB1 transmembrane domain comprises SEQ ID NO: 132 or a sequence at least 90%, at least 95%, at least 97%, at least 99% or is identical to SEQ ID NO: 132.

In some embodiments of the immune cells of the disclosure, the second receptor comprises a sequence of SEQ ID NO: 164, or a sequence having at least 90%, at least 95%, at least 97%, or at least 99% identity thereto.

In some embodiments of the immune cells of the disclosure, the CEA+ cancer cell is a pancreatic cancer cell, a colorectal cancer cell, a lung cancer cell, an esophageal cancer cell, gastric cancer cell, a head-and-neck cancer cell, a gallbladder cancer cell, a diffuse large B cell cancer cell, or acute myeloid leukemia cancer cell. In some embodiments, the CEA+ cancer cell is a lung cancer cell, a colorectal cancer cell, or a pancreatic cancer cell. In some embodiments, the CEA+ cancer cell is a CEA+/HLA-A*02− cancer cell that does not express HLA-A*02. In some embodiments, the CEA+/HLA-A*02− cancer cell is derived from a CEA+/HLA-A*02+ cell by loss of heterozygosity at HLA-A leading to loss of HLA-A*02. In some embodiments, the first receptor and the second receptor together specifically activate the immune cell in the presence of the CEA+/HLA-A*02− cancer cell having loss of heterozygosity. In some embodiments, the first receptor and the second receptor together do not specifically activate the immune cell in the presence of an CEA+ cell that has not lost HLA-A*02 by loss of heterozygosity.

In some embodiments of the immune cells of the disclosure, the immune cell is a T cell. In some embodiments, the T cell is a CD8+ CD4− T cell.

In some embodiments of the immune cells of the disclosure, expression and/or function of a MHC Class I gene has been reduced or eliminated. In some embodiments, the MHC Class I gene is beta-2-microglobulin (B2M). In some embodiments, the immune cells further comprise a polynucleotide comprising an interfering RNA, the interfering RNA comprising a sequence complementary to a sequence of a B2M mRNA. In some embodiments, the interfering RNA comprises a sequence selected from the group of sequences set forth in Table 11, or a sequence having at most 1, 2, 3, or 4 substitutions, insertions or deletions relative thereto. In some embodiments, the interfering RNA is capable of inducing RNAi-mediated degradation of the B2M mRNA. In some embodiments, the interfering RNA is a short hairpin RNA (shRNA). In some embodiments, the shRNA comprises: (a) a first sequence, having from 5' end to 3' end a sequence complementary to a sequence of the B2M mRNA; and (b) a second sequence, having from 5' end to 3' end a sequence complementary to the first sequence, wherein the first sequence and the second sequence form the shRNA. In some embodiments, the shRNA is encoded by a sequence comprising a sequence of GCACTCAAAGCTTGTTAAGATCGAAATCTTAACAAGCTTTGAGTGC (SEQ ID NO: 179) or GTTAACTTCCAATTTACATACCGAAGTATGTAAATTGGAAGTTAAC (SEQ ID NO: 180), or a sequence having at least 80%, at least 90%, or at least 95% identity thereto.

In some embodiments of the immune cells of the disclosure, expression and/or function of a MHC Class I gene has been reduced or eliminated. In some embodiments, the MHC Class I gene is beta-2-microglobulin (B2M). In some embodiments, the immune cells further comprise one or more modifications to a sequence encoding B2M, wherein the one or more modifications reduce the expression and/or eliminate the function of B2M. In some embodiments, the one or more modifications comprise one or more inactivating mutations of the endogenous gene encoding B2M. In some embodiments, the one or more inactivating mutations comprise a deletion, an insertion, a substitution, or a frameshift mutation. In some embodiments, the one or more inactivating mutations are introduced with a nucleic acid guided endonuclease in a complex with at least one guide nucleic acid (gNA) that specifically targets a sequence of the endogenous gene encoding B2M. In some embodiments, the gNA comprises a sequence selected from the group of sequences set forth in Table 10, or a sequence having at most 1, 2, 3, or 4 substitutions, insertions or deletions relative thereto.

In some embodiments of the immune cells of the disclosure, expression and/or function of a MHC Class I gene has been reduced or eliminated. In some embodiments, the MHC Class I gene is HLA-A*02. In some embodiments, the immune cells further comprise a polynucleotide comprising an interfering RNA, comprising a sequence complementary to a sequence of an HLA-A*02 mRNA. In some embodiments, the interfering RNA is capable of inducing RNA interference (RNAi)-mediated degradation of the HLA-A*02 mRNA. In some embodiments, the interfering RNA is a short hairpin RNA (shRNA) comprising: (a) a first sequence, having from 5' end to 3' end a sequence complementary to a sequence of the HLA-A*02 mRNA; and (b) a second sequence, having from 5' end to 3' end a sequence complementary to the first sequence, wherein the first sequence and the second sequence form the shRNA. In some embodiments, the shRNA comprises a sequence selected from the group of sequences set forth in Table 12.

In some embodiments of the immune cells of the disclosure, expression and/or function of a MHC Class I gene has been reduced or eliminated. In some embodiments, the MHC Class I gene is HLA-A*02. In some embodiments, the immune cells comprise one or more modifications to a sequence of an endogenous gene encoding HLA-A*02, wherein the one or modifications reduce the expression and/or eliminate the function of HLA-A*02. In some embodiments, the one or more modifications comprise one or more inactivating mutations of the endogenous gene encoding HLA-A*02. In some embodiments, the one or more inactivating mutations are introduced with a nucleic acid guided endonuclease in a complex with at least one guide nucleic acid (gNA) that specifically targets a sequence of the endogenous gene encoding HLA-A*02. In some embodiments, the gNA comprises a sequence as set forth in Table 9.

In some embodiments of the immune cells of the disclosure, the first receptor comprises a sequence of SEQ ID NO: 52, and the second receptor comprises a sequence of SEQ ID NO: 164, or sequences having at least 90%, at least 95%, at least 97% or at least 99% identity thereto. In some embodiments, the immune cells comprise an shRNA encoded by a sequence comprising GCACTCAAAGCTTGTTAAGATCGAAATCTTAACAAGCTTTGAGTGC (SEQ ID NO: 179) or a sequence having at least 80%, at least 90%, or at least 95% identity thereto. In some embodiments, the first receptor and second receptor are encoded by a single polynucleotide, and wherein the sequences encoding the first and second receptors are separated by a sequence encoding a self-cleaving polypeptide. In some embodiments, the self-cleaving polypeptide comprises a T2A self-cleaving polypeptide comprising a sequence of GSGEGRGSLLTCGDVEENPGP (SEQ ID NO: 181).

In some embodiments of the immune cells of the disclosure, the immune cells are autologous.

In some embodiments of the immune cells of the disclosure, the immune cells are allogeneic.

The disclosure provides a pharmaceutical composition, comprising a therapeutically effective amount of the immune cells of the disclosure. In some embodiments, the pharmaceutical composition further comprises a pharmaceutically acceptable carrier, diluent or excipient.

The disclosure provides a pharmaceutical composition, comprising a therapeutically effective amount of the immune cells of the disclosure for use as a medicament in the treatment of CEA+ cancer.

The disclosure provides a polynucleotide or polynucleotide system, comprising one or more polynucleotides comprising polynucleotide sequences encoding: (a) a first receptor, comprising an extracellular ligand binding domain specific to CEA cell adhesion molecule 5 positive (CEA); and (b) a second receptor, comprising an extracellular ligand binding domain specific to anon-target antigen that has been lost in the CEA+ cancer cell, wherein the first receptor is an activator receptor responsive to CEA on the CEA+ cancer cell; and wherein the second receptor is an inhibitory receptor responsive to the non-target antigen.

In some embodiments of the polynucleotide or polynucleotide system of the disclosure, the polynucleotide or polynucleotide system comprises one or more polynucleotides comprising polynucleotide sequences encoding the first receptor and the second receptor for use in generating the immune cells of the disclosure.

In some embodiments of the polynucleotide or polynucleotide system of the disclosure, the polynucleotide or polynucleotide system comprises a sequence encoding an shRNA specific to B2M. In some embodiments, the sequences encoding the first receptor, the second receptor and the shRNA specific to B2M are encoded by the same polynucleotide. In some embodiments, (a) the sequence encoding the shRNA specific to B2M comprises GCACTCAAAGCTTGTTAAGATCGAAATCTTAACAAGCTTTGAGTGC (SEQ ID NO: 179) or a sequence having at least 80%, at least 90%, or at least 95% identity thereto; (b) the sequence encoding the first receptor comprises SEQ ID NO: 143, or a sequence having at least 80%, at least 90%, or at least 95% identity thereto; and (c) the sequence encoding the second receptor comprises SEQ ID NO: 165, or a sequence having at least 80%, at least 90%, or at least 95% identity thereto.

The disclosure provides vectors comprising one or more polynucleotides of the disclosure.

The disclosure provides methods of killing CEA+ cancer cell having loss of heterozygosity at an MHC class I locus, comprising administering to the subject an effective amount of the immune cells or pharmaceutical composition of the disclosure.

The disclosure provides methods of treating CEA+ cancer in a subject having a CEA+ tumor having loss of heterozygosity at an MHC class I locus, comprising administering to the subject an effective amount of the immune cells or pharmaceutical composition of the disclosure.

The disclosure provides methods of treating a cancer in a subject comprising: (a) determining HLA-A genotype or expression of normal cells and a plurality of cancer cells of the subject; (b) optionally, determining the expression of CEA in a plurality of cancer cells of the subject; and (c) administering to the subject an effective amount of the immune cells or pharmaceutical composition of the disclosure if the normal cells express HLA-A*02 and the plurality of cancer cells do not express HLA-A*02, and the plurality of cancer cells are CEA-positive.

In some embodiments of the methods of the disclosure, the subject is a heterozygous HLA-A*02 patient with a malignancy that expresses CEA (CEA+) and has lost HLA-A*02 expression. In some embodiments, the subject is a heterozygous HLA-A*02 patient with recurrent unresectable or metastatic solid tumors that express CEA and have lost HLA-A*02 expression. In some embodiments, the cancer comprises pancreatic cancer, colorectal cancer, lung cancer, esophageal cancer, gastric cancer, head-and-neck cancer, gallbladder cancer, diffuse large B cell cancer, or acute myeloid leukemia. In some embodiments, the cancer comprises lung cancer, colorectal cancer, or pancreatic cancer.

In some embodiments of the methods of the disclosure, the cancer cells comprise CEA+/HLA-A*02− cancer cells that do not express HLA-A*02. In some embodiments, the CEA+/HLA-A*02− cancer cells are derived from a CEA+/HLA-A*02+ cell by loss of heterozygosity at HLA-A leading to loss of HLA-A*02. In some embodiments, the first receptor and the second receptor together specifically activate the immune cell in the presence of the CEA+/HLA-A*02− cancer cells. In some embodiments, the first receptor and the second receptor together do not specifically activate the immune cell in the presence of a CEA+ cell that has not lost HLA-A*02.

In some embodiments of the methods of the disclosure, administration of the immune cells or the pharmaceutical composition reduces the size of a tumor in the subject. In some embodiments, the tumor is reduced by about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, or about 100%. In some embodiments, the tumor is eliminated. In some embodiments, administration of the immune cells or the pharmaceutical composition arrests the growth of a tumor in the subject. In some embodiments, administration of the immune cell or the pharmaceutical composition reduces the number of tumors in the subject.

In some embodiments of the methods of the disclosure, administration of the immune cells or the pharmaceutical composition results in selective killing of a cancer cell but not a normal cell in the subject. In some embodiments, at least about 60% of the cells killed are cancer cells, at least about 65% of the cells killed are cancer cells, at least about 70% of the cells killed are cancer cells, at least about 75% of the cells killed are cancer cells, at least about 80% of the cells killed are cancer cells, at least about 85% of the cells killed are cancer cells, at least about 90% of the cells killed are cancer cells, at least about 95% of the cells killed are cancer cells, or about 100% of the cells killed are cancer cells. In some embodiments, administration of the immune cell or pharmaceutical composition results in the killing of at least about 40%, about 50%, about 60%, about 70%, about 80%, about 90% or all of the cancer cells of the subject.

In some embodiments of the methods of the disclosure, administration of the immune cells or the pharmaceutical composition results in fewer side effects for the subject than administration of an otherwise equivalent immune cell comprising the first activator receptor but no second inhibitory receptor.

The disclosure provides methods of making a plurality of immune cells, comprising: (a) providing a plurality of immune cells, and (b) transforming the plurality of immune cells with the polynucleotide, polynucleotide system or vector of the disclosure.

The disclosure provides kits comprising the immune cells or pharmaceutical composition of the disclosure. In some embodiments, the kit further comprises instructions for use.

BRIEF DESCRIPTION OF THE DRAWINGS

FIG. 4 is a table showing that the addressable colorectal cancer (CRC) patient population that can be treated with a CEA TCR in combination with a RANK blocker receptor is estimated at 2,000 to 5,000 patients, depending on which RANK variant is used. In the table, the subtotal above of treatable patients is 5-11 thousand, and include the percentage of high CEA+ patients, as noted. Treated patients are calculated as: HLA-A*02 carrier freq. (0.5)× random loss (0.5)×RANK variant het freq. (0.2-0.5)× cancer RANK LOH freq.=[0.05-0.125]×LOH freq.

FIG. 9 is a table showing estimated deaths in the U.S. by cancer site, statistics taken from the American Cancer Society.

FIG. 12 is a pair of diagrams showing discrimination between tumor and normal tissue using loss of heterozygosity (LOH). Engineered immune cells kill tumors but spare normal cells. In the case of an exemplary embodiment, immune cells express CEA CAR, the activator antigen is CEA, and the blocker antigen is HLA-A*02. Patients with germline heterozygosity of HLA-A*02 and clonal LOH of HLA-A*02 in tumors are selected.

FIG. 18 shows the cell-surface expression of CEA and HLA-A*02 by mRNA titration in HeLa cells. A*02: HLA-A*02.

FIG. 22 shows standard curves used to convert molecules/cell to TPM values. Data in the CEA standard curve (left) show CEA cell surface expression from Bacac et al. 2016, Clin Cancer Res 22, 3286-3297 plotted against mRNA (TPM) from the GTEx database. TPM: transcripts per million.

FIG. 47 shows that CRISPR using a guide RNA (gRNA) to B2M and a B2M shRNA reduce HLA expression on cell surface and increase blocker receptor availability in HLA-A*02(+) T cells.

FIG. 50 shows that the HLA-A*02 LILRB1 inhibitory receptor is equally sensitive in HLA-A*02(+) and HLA-A*02(−) Jurkat cells when assayed using HeLa target cells.

FIG. 53 is a table summarizing the properties of a dual receptor system of some embodiments described herein.

DETAILED DESCRIPTION

Figure 1:
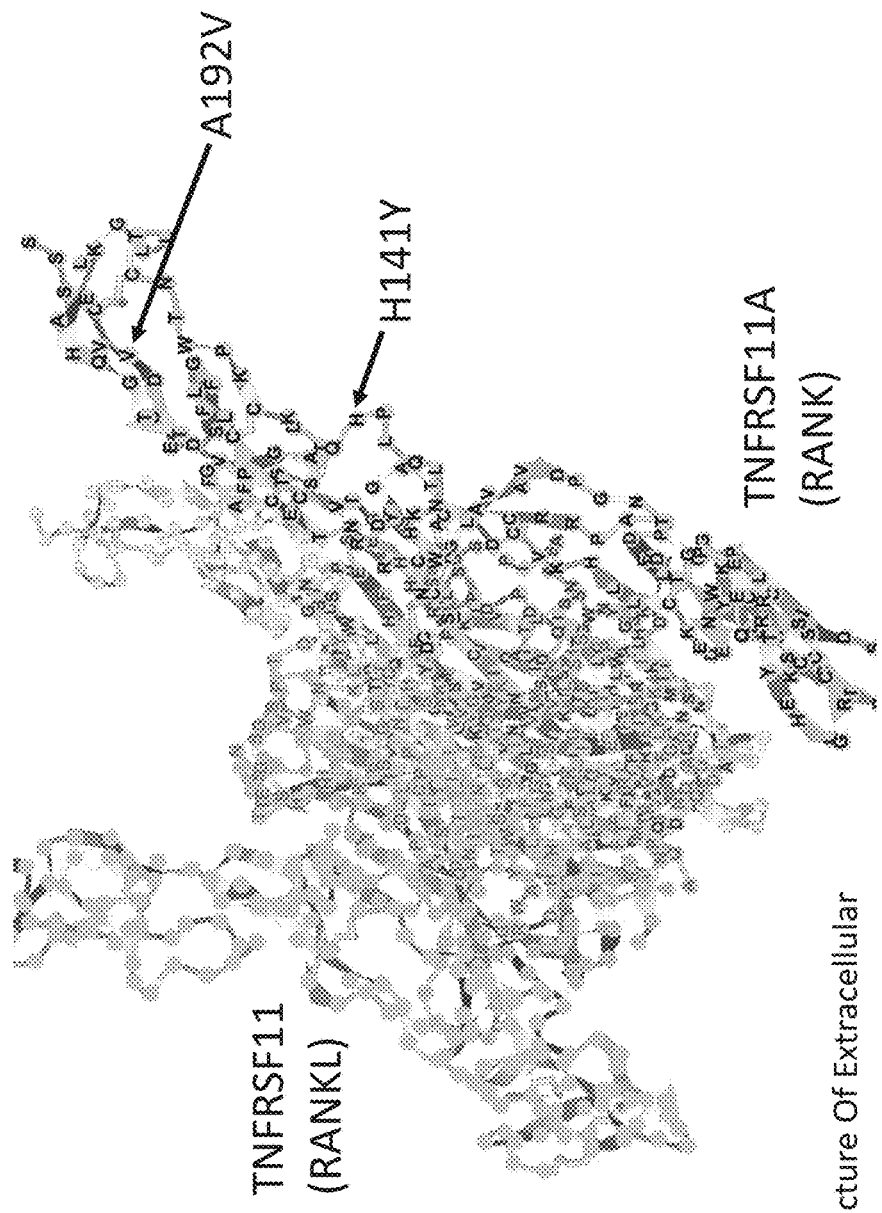
FIG. 1 is a crystal structure of TNFRSF11A (RANK) bound to TNFRS11 (RANKL), showing that the variant TNFRSF11A epitopes are on the protein surface, and presumably accessible to an antibody.
Figure 2:
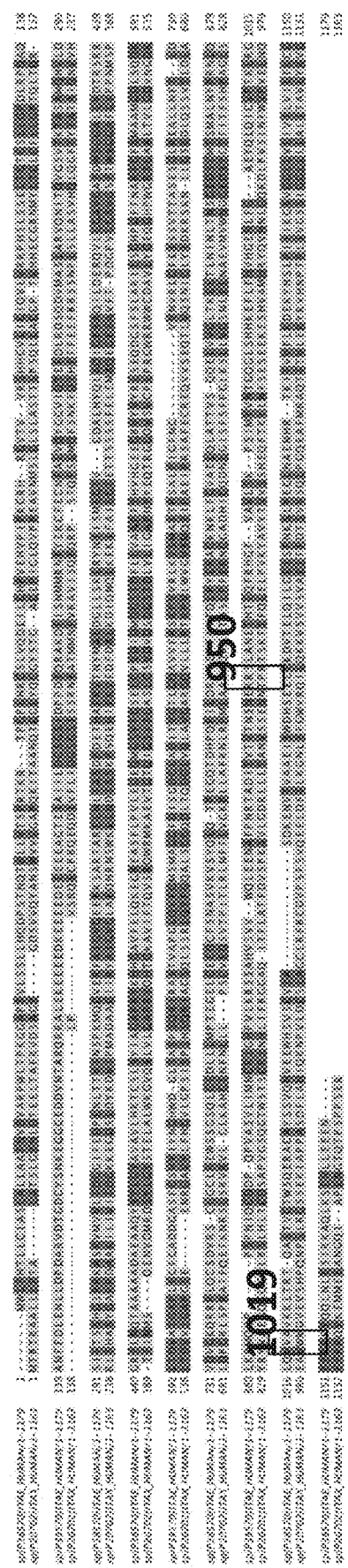
FIG. 2 shows an alignment of human Integrin alpha-E (ITGAE) (SEQ ID NO: 182) with human Integrin alpha-X (ITGAX, P20702, ITAX_HUMAN) (SEQ ID NO: 183). SNP variants in ITGAE rs1716 R950W (MAF 0.2654, from the 1000 Genomes project) and rs2976230 V1019A/V1019G (MAF 0.282, from the 1000 Genomes project) are shown in boxes.
Figure 3:
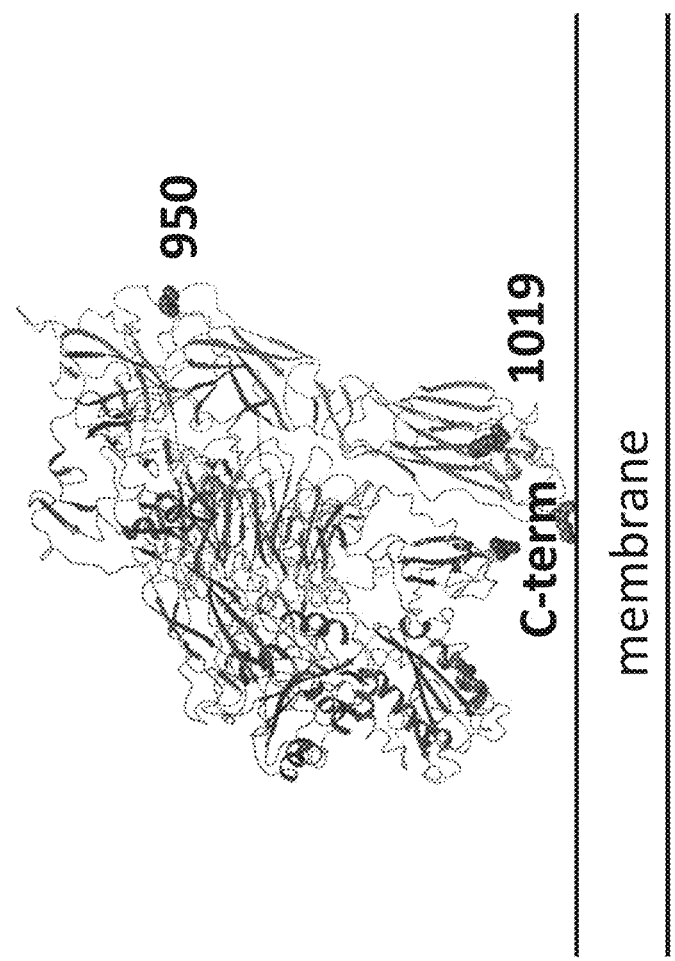
FIG. 3 is a crystal structure of the inactive conformation of ITGAX, which has 27% identity to ITGAE. The positions of the ITGAE SNPs are indicated as labeled.
Figure 5:
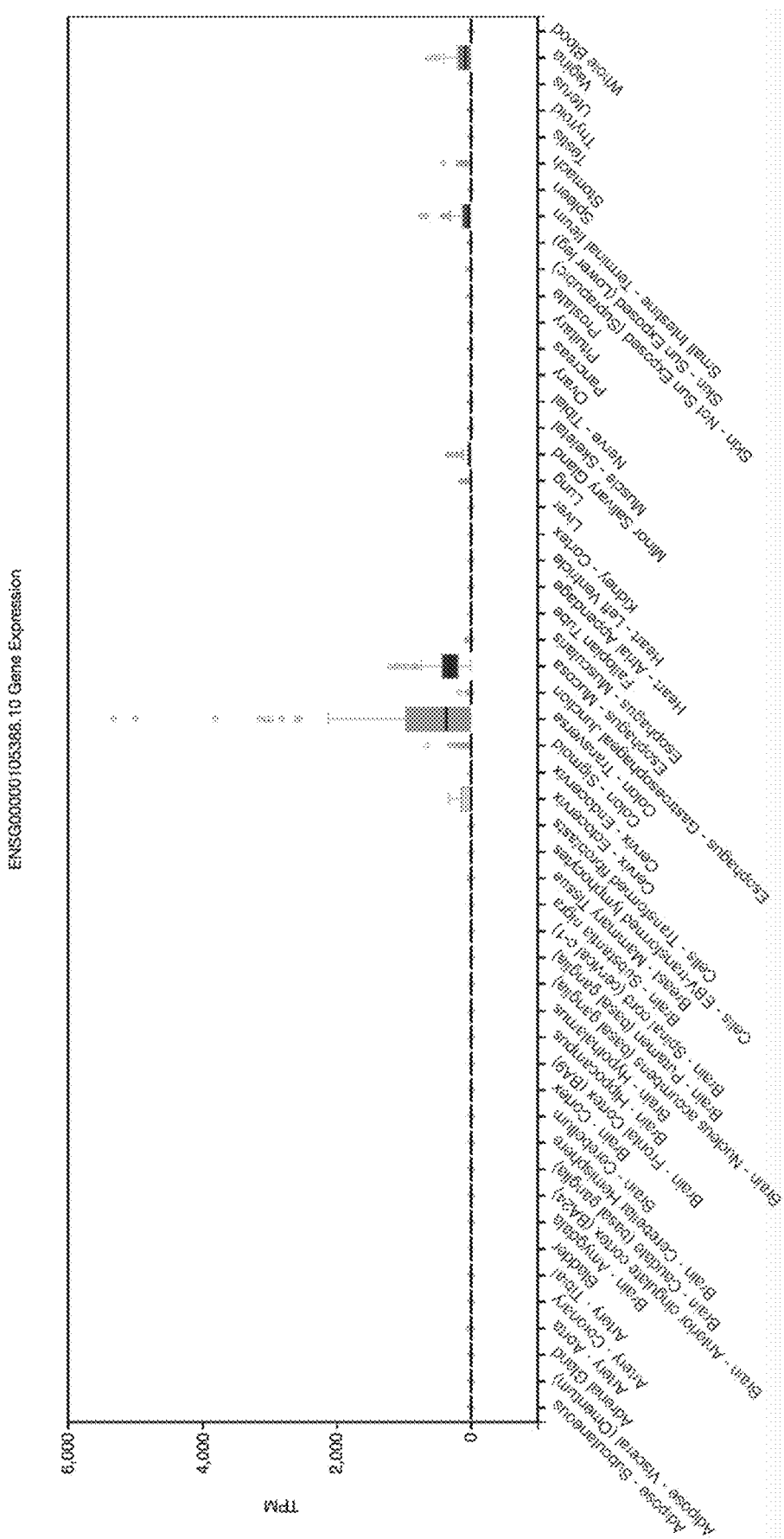
FIG. 5 shows the expression of CEA (CEACAM5) in normal tissues.
Figure 6:
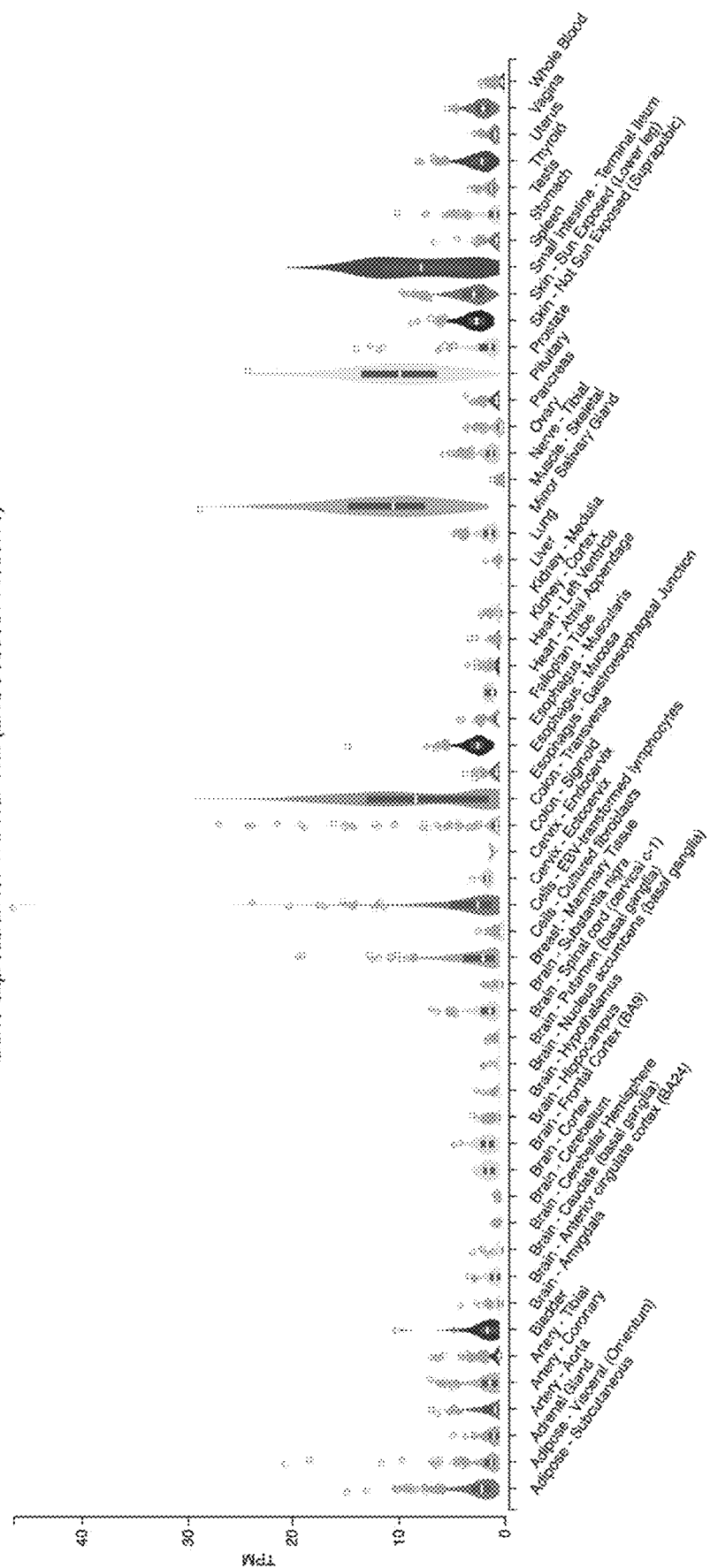
FIG. 6 shows the expression of TNFRSF11A (RANK) in normal tissues.

Provided herein are compositions and methods for treating cancers using immune cells comprising a two-receptor system responsive to differences in gene expression of a ligand between cancer and normal, wild type cells. These differences in expression can be due to loss of heterozygosity in the cancer cells. Alternatively, the differences in expression can be because the gene expression is not expressed in cancer cells, or is expressed in cancer cells at a lower level than normal cells. The two-receptor system is expressed in immune cells, for example immune cells used in adoptive cell therapy, and targets activity of these immune cells to cancer cells exhibiting loss of heterozygosity or expression differences. In this two-receptor system, the first receptor (an activator receptor, sometimes referred to herein as an A module) activates, or promotes activation of the immune cells, while the second receptor (an inhibitory receptor, sometimes referred to herein as a blocker, or inhibitor receptor, or a B module) acts to inhibit activation of the immune cells by the first receptor. Each receptor contains a ligand-binding domain (LBD) that binds a specific ligand. Signals from the two receptors upon ligand binding are integrated by the immune cell. Differential expression of ligands for the first and second receptors in cancer and normal cells, for example through loss of heterozygosity of the locus encoding the inhibitory ligand in cancer cells, or differences in transcription levels, mediates activation of immune cells by target cancer cells that express the first activator ligand but not the second inhibitory ligand.

In particular embodiments of the compositions and methods provided herein, immune cells comprising the two-receptor system described herein are used to treat CEA cell adhesion molecule 5 (CEA) positive cancers. This includes CEA-positive cancers of the gastro-intestinal (GI) tract. In the case of CEA-positive cancers, the target antigen of the activator receptor is CEA, or a peptide antigen thereof, in a complex with a major histocompatibility complex class I (MHC-I). CEA is predominantly expressed in normal adult in GI tissues as a surface protein that can be cleaved from the membrane and released in soluble form. Because of its selective expression in GI tumors, it has long been considered an attractive tumor-specific antigen that could mediate selective killing of GI tumors if CEA-positive cancer cells could be specifically targeted with an appropriate therapeutic. Moreover, the CEA gene product is an attractive target for cancer because of its high expression in virtually all colorectal tumors (and a large subset of other solid tumors) and limited expression in adult tissues. However, normal CEA expression in non-cancer (non-target) cells has prevented the effective use of CEA for targeted therapies such as adoptive cell therapies. Several therapeutics directed against CEA have been tested in the clinic and were found to induce colitis as a dose-limiting toxicity (DLT). In 2011, a clinical study with a murine TCR directed against a CEA peptide complexed with HLA-A*02 (i.e., a pMHC) was stopped in a Phase 1 study (n=3) because of localized toxicity to the colon (Parkhurst et al. Molecular Therapy 2011 19(3): P620-626; Parkhurst et al. Clin Cancer Res. 2009 Jan. 1; 15(1): 169-180). DLT occurred at a remarkably low dose of 2-4E8 cells/patient.

HLA heterozygous gene loss in a subset of tumors can be exploited to protect patients from on-target, off-tumor toxicity. By pairing an activator receptor with an inhibitory receptor, the methods provided herein increase the specificity of adoptive cell therapies and decrease harmful effects associated with these therapies, such as dose-limited toxicity. Immune cells comprising the CEA activator receptor and an HLA-A*02 specific inhibitory receptor selectively killed A*02(−) tumor cells in vitro and in vivo. These immune cells were as potent as clinically active CEA TCR-T cells, but highly selective for tumor cells that lacked HLA-A*02. The CEA CAR paired with an inhibitory receptor is a solid tumor therapeutic candidate whose activity is directed by a gene deleted in tumor cells such that normal tissue may be protected from CEA-mediated cytotoxicity.

In some embodiments, the ligand for the activator is a CEA peptide complexed with MHC class I, for example an MHC complex comprising an HLA-A*02. In the methods described herein, this CEA targeted activator receptor is paired with an inhibitory receptor, which increases the safety window of the activator by blocking its cytolytic effect on normal CEA-positive tissues. Without wishing to be bound by theory, these tissues are thought to be mostly in the gastrointestinal tract. However, the activator receptor still directs the targeted killing of tumor cells by immune cells comprising the two-receptor system, as the tumor cells do not express the ligand for the inhibitor, or blocker, receptor. The target for the second, inhibitory receptor is expressed by gastrointestinal (GI) tissues but is not expressed in cancer cells, and the inhibitory receptor recognizes this "non-target antigen" as an inhibitory stimulus. An exemplary target for the second inhibitory receptor is expressed on the surface of normal GI epithelial cells, and is lost from GI tumor cells through loss of heterozygosity (LOH) or other mechanisms, leaving a single allelic form in cancer cells that can be distinguished from other alleles via an allele-specific ligand binding domain on the inhibitory receptor. Exemplary targets of the inhibitory receptor include, but are not limited to, Major Histocompatibility Complex (MHC) proteins such as human leukocyte antigen A (HLA-A). HLA-B, HLA-C, and other HLAs. HLAs are encoding by variant genes, such as HLA-A*01, HLA-A*02, HLA-A*03, HLA-C*07, and others, which can be lost from CEA positive cancer cells through loss of heterozygosity. Alternatively, further exemplary targets of the inhibitory receptor include, but are not limited to, TNF receptor superfamily member 11a (TNFRSF11A, also called RANK), integrin subunit alpha E (ITGAE), cholinergic receptor nicotinic beta 1 subunit (ACHRB, or CHRNB), transient receptor potential cation channel subfamily V member 1 (TRPV1), and scavenger receptor class F member 1 (SREC, or SCARF). Each of these has a common nonsynonymous variant form, with the amino-acid alteration in its extracellular domain accessible to antibodies, which can be used as a B module target for a cellular integrator designed to safely treat GI cancer patients with engineered T cells activated by an activator receptor such as a CEA or CEA pMHC responsive activator receptor.

The compositions and methods of the disclosure can reduce or eliminate dose limiting toxicity (DLT) caused by expression of CEA on normal GI tissue. Without wishing to be bound by theory, it is thought that expression of CEA, while limited, is sufficiently high in the GI tract to induce adverse events of a severity that has prevented further advancement of CEA as a target for adoptive cell therapy or immunotherapy in the clinic. The disclosure provides methods of targeting CEA in cancer cells to treat CEA-positive cancers using adoptive cell therapies by adding a second inhibitory receptor that blocks activation of the adoptive immune cells in the presence of a second ligand (a ligand other than CEA, termed the non-target antigen or alternatively, blocker antigen). Using the compositions and methods described herein, tumor cells that express CEA are attacked by the adoptive immune cells expressing the two receptors because these tumor cells express only the activator ligand, CEA. In contrast, normal cells that express CEA plus the non-target antigen (alternatively termed a "blocker antigen") are protected from the adoptive immune cells. The inhibitory receptor response to the non-target antigen on normal cells prevents activation of immune cells by the CEA-targeted activator receptor. This dual-targeting approach creates the therapeutic window that will allow a CEA-directed cell therapy to be dosed safely and effectively in CEA-positive cancer patients.

The disclosure provides methods and compositions that allow the use of potent CEA CAR and TCRs that induce on-target toxicity, and renders these CEA targeted receptors useful as a therapeutic by mitigating their toxicity. None of the existing therapeutics that have been tested in the clinic, including cell and large-molecule therapies, provide a mechanism to protect normal CEA-positive tissues.

In variations, the compositions and methods described herein may be used to kill target cells and/or treat subjects in which expression of the non-target antigen is partially or completely decreased by causes other than loss of heterozygosity, including but not limited to partial gene deletion, epigenetic silencing, and point mutations or truncating mutations in the sequence encoding the non-target antigen.

Definitions

Prior to setting forth this disclosure in more detail, it may be helpful to an understanding thereof to provide definitions of certain terms to be used herein.

Unless defined otherwise, all technical and scientific terms used herein have the same meaning as commonly understood by those of ordinary skill in the art to which the disclosure belongs. Although any methods and materials similar or equivalent to those described herein can be used in the practice or testing of particular embodiments, preferred embodiments of compositions, methods and materials are described herein. For the purposes of the present disclosure, the following terms are defined below. Additional definitions are set forth throughout this disclosure.

As used herein, the term "about" or "approximately" refers to a quantity, level, value, number, frequency, percentage, dimension, size, amount, weight or length that varies by as much as 15%, 10%, 9%, 8%, 7%, 6%, 5%, 4%, 3%, 2% or 1% to a reference quantity, level, value, number, frequency, percentage, dimension, size, amount, weight or length. In one embodiment, the term "about" or "approximately" refers a range of quantity, level, value, number, frequency, percentage, dimension, size, amount, weight or length ±15%, ±10%, 9%, ±8%, ±7%, ±6%, ±5%, ±4%, ±3%, ±2%, or ±1% about a reference quantity, level, value, number, frequency, percentage, dimension, size, amount, weight or length.

As used herein, the term "isolated" means material that is substantially or essentially free from components that normally accompany it in its native state. In particular embodiments, the term "obtained" or "derived" is used synonymously with isolated.

The terms "subject," "patient" and "individual" are used interchangeably herein to refer to a vertebrate, preferably a mammal, more preferably a human. Tissues, cells, and their progeny of a biological entity obtained in vivo or cultured in vitro are also encompassed. A "subject," "patient" or "individual" as used herein, includes any animal that exhibits pain that can be treated with the vectors, compositions, and methods contemplated herein. Suitable subjects (e.g., patients) include laboratory animals (such as mouse, rat, rabbit, or guinea pig), farm animals, and domestic animals or pets (such as a cat or dog). Non-human primates and, preferably, human patients, are included.

As used herein "treatment" or "treating," includes any beneficial or desirable effect, and may include even minimal improvement in symptoms. "Treatment" does not necessarily indicate complete eradication or cure of the disease or condition, or associated symptoms thereof.

As used herein, "prevent," and similar words such as "prevented," "preventing" etc., indicate an approach for preventing, inhibiting, or reducing the likelihood of a symptom of disease. It also refers to delaying the onset or recurrence of a disease or condition or delaying the occurrence or recurrence of the symptoms of a disease. As used herein, "prevention" and similar words also includes reducing the intensity, effect, symptoms and/or burden of disease prior to onset or recurrence.

As used herein, the term "amount" refers to "an amount effective" or "an effective amount" of a virus to achieve a beneficial or desired prophylactic or therapeutic result, including clinical results.

A "therapeutically effective amount" of a virus or cell may vary according to factors such as the disease state, age, sex, and weight of the individual, and the ability of the virus or cell to elicit a desired response in the individual. A therapeutically effective amount is also one in which any toxic or detrimental effects of the virus or cell are outweighed by the therapeutically beneficial effects. The term "therapeutically effective amount" includes an amount that is effective to "treat" a subject (e.g., a patient).

An "increased" or "enhanced" amount of a physiological response, e.g., electrophysiological activity or cellular activity, is typically a "statistically significant" amount, and may include an increase that is 1.1, 1.2, 1.5, 2, 3, 4, 5, 6, 7, 8, 9, 10, 15, 20, 30 or more times (e.g., 500, 1000 times) (including all integers and decimal points in between and above 1, e.g., 1.5, 1.6, 1.7. 1.8, etc.) the level of activity in an untreated cell.

A "decreased" or "reduced" amount of a physiological response, e.g., electrophysiological activity or cellular activity, is typically a "statistically significant" amount, and may include an decrease that is 1.1, 1.2, 1.5, 2, 3, 4, 5, 6, 7, 8, 9, 10, 15, 20, 30 or more times (e.g., 500, 1000 times) (including all integers and decimal points in between and above 1, e.g., 1.5, 1.6, 1.7. 1.8, etc.) the level of activity in an untreated cell.

By "maintain," or "preserve," or "maintenance," or "no change," or "no substantial change," or "no substantial decrease" refers generally to a physiological response that is comparable to a response caused by either vehicle, or a control molecule/composition. A comparable response is one that is not significantly different or measurable different from the reference response.

In general, "sequence identity" or "sequence homology" refers to an exact nucleotide-to-nucleotide or amino acid-to-amino acid correspondence of two polynucleotides or polypeptide sequences, respectively. Typically, techniques for determining sequence identity include determining the nucleotide sequence of a polynucleotide and/or determining the amino acid sequence encoded thereby, and comparing these sequences to a second nucleotide or amino acid sequence. Two or more sequences (polynucleotide or amino acid) can be compared by determining their "percent identity." The percent identity of two sequences, whether nucleic acid or amino acid sequences, is the number of exact matches between two aligned sequences divided by the length of the shorter sequences and multiplied by 100. Percent identity may also be determined, for example, by comparing sequence information using the advanced BLAST computer program, including version 2.2.9, available from the National Institutes of Health. The BLAST program is based on the alignment method of Karlin and Altschul, Proc. Natl. Acad. Sci. USA 87:2264-2268 (1990) and as discussed in Altschul, et al., J. Mol. Biol. 215:403-410 (1990); Karlin And Altschul, Proc. Natl. Acad. Sci. USA 90:5873-5877 (1993); and Altschul et al., Nucleic Acids Res. 25:3389-3402 (1997). Briefly, the BLAST program defines identity as the number of identical aligned symbols (generally nucleotides or amino acids), divided by the total number of symbols in the shorter of the two sequences. The program may be used to determine percent identity over the entire length of the proteins being compared. Default parameters are provided to optimize searches with short query sequences in, for example, with the blastp program. The program also allows use of an SEG filter to mask-off segments of the query sequences as determined by the SEG program of Wootton and Federhen, Computers and Chemistry 17:149-163 (1993). Ranges of desired degrees of sequence identity are approximately 80% to 100% and integer values therebetween. Typically, the percent identities between a disclosed sequence and a claimed sequence are at least 80%, at least 85%, at least 90%, at least 95%, or at least 98%.

As used herein, a "polynucleotide system" refers to one or more polynucleotides. The one or more polynucleotides may be designed to work in concert for a particular application, or to produce a desired transformed cell.

The term "exogenous" is used herein to refer to any molecule, including nucleic acids, protein or peptides, small molecular compounds, and the like that originate from outside the organism. In contrast, the term "endogenous" refers to any molecule that originates from inside the organism (i.e., naturally produced by the organism).

The term "MOI" is used herein to refer to multiplicity of infection, which is the ratio of agents (e.g. viral particles) to infection targets (e.g. cells).

In the present description, any concentration range, percentage range, ratio range, or integer range is to be understood to include the value of any integer within the recited range and, when appropriate, fractions thereof (such as one tenth and one hundredth of an integer), unless otherwise indicated. The term "about", when immediately preceding a number or numeral, means that the number or numeral ranges plus or minus up to 10%.

As used herein, a "target cell" refers to cell that is targeted by an adoptive cell therapy. For example, a target cell can be cancer cell, which can be killed by the transplanted T cells of the adoptive cell therapy. Target cells of the disclosure express a target antigen, as described herein, and do not express a non-target antigen.

As used herein, a "non-target cell" refers to cell that is not targeted by an adoptive cell therapy. For example, in an adoptive cell targeting cancer cells, normal, healthy, non-cancerous cells are non-target cells. Some, or all, non-target cells in a subject may express both the target antigen and the non-target antigen. Non-target cells in a subject may express the non-target antigen irrespective of whether or not these cells also express the target antigen.

As used herein, "a non-target allelic variant" refers to an allele of a gene whose product is expressed by non-target cells, but is not expressed by target cells. For example, a non-target allelic variant is an allele of a gene that is expressed by normal, non-cancer cells of subject, but not expressed by cancer cells of the subject. The expression of the non-target allelic variant can be lost in the cancer cells by any mechanism, including, but not limited to, loss of heterozygosity, mutation, or epigenetic modification of the gene encoding the non-target allelic variant.

As used herein, "specific to" or "specifically binds to" when used with respect to a ligand binding domain, such as an antigen binding domain, refers to a ligand binding domain that has a high specificity for a named target. Antibody specificity can viewed as a measure of the goodness of fit between the ligand binding domain and the corresponding ligand, or the ability of the ligand binding domain to discriminate between similar or even dissimilar ligands. In comparison with specificity, affinity is a measure of the strength of the binding between the ligand binding domain and ligand, such that a low-affinity ligand binding domain binds weakly and high-affinity ligand binding domain binds firmly. A ligand binding domain that is specific to a target allele is one that can discriminate between different alleles of a gene. For example, a ligand binding domain that is specific to HLA-A*02 will not bind, or bind only weakly to, other HLA-A alleles such as HLA-A*01 or HLA-A*03. The person of skill in the art will appreciate that a ligand binding domain can be said to be specific to a particular target, and yet still have low levels of binding to one or more additional targets that do not affect its function in the receptor systems described herein.

As used herein, a "target antigen," whether referred to using the term antigen or the name of a specific antigen, refers to an antigen expressed by a target cell, such as a cancer cell. Expression of target antigen is not limited to target cells. Target antigens may be expressed by both cancer cells and normal, non-cancer cells in a subject.

As used herein, a "non-target antigen" (or "blocker antigen") whether referred to using the term antigen or the name of a specific antigen, refers to an antigen that is expressed by normal, non-cancer cells and is not expressed in cancer cells. This difference in expression allows the inhibitory receptor to inhibit immune cell activation in the presence of non-target cells, but not in the presence of target cells.

Polymorphism refers to the presence of two or more variants of a nucleotide sequence in a population. A polymorphism may comprise one or more base changes, an insertion, a repeat, or a deletion. A polymorphism includes e.g. a simple sequence repeat (SSR) and a single nucleotide polymorphism (SNP), which is a variation, occurring when a single nucleotide of adenine (A), thymine (T), cytosine (C) or guanine (G) is altered.

As used herein, "affinity" refers to strength of binding of a ligand to a single ligand binding site on a receptor, for example an antigen for the antigen binding domain of any of the receptors described herein. Ligand binding domains can have a weaker interaction (low affinity) with their ligand, or a stronger interaction (high affinity).

Kd, or dissociation constant, is a type of equilibrium constant that measures the propensity of a larger object to separate reversibly into smaller components, such as, for example, when a macromolecular complex comprising receptor and its cognate ligand separates into the ligand and the receptor. When the Kd is high, it means that a high concentration of ligand is need to occupy the receptor, and the affinity of the receptor for the ligand is low. Conversely, a low Kd means that the ligand has a high affinity for the receptor.

As used herein, a receptor that is "responsive" or "responsive to" refers to a receptor comprising an intracellular domain, that when bound by a ligand (i.e. antigen) generates a signal corresponding to the known function of the intracellular domain. An activator receptor bound to a target antigen can generate a signal that causes activation of an immune cell expressing the activator receptor. An inhibitory receptor bound to a non-target antigen can generate an inhibitory signal that prevents or reduces activation of an immune cell expressing the activator receptor. Responsiveness of receptors, and their ability to activate or inhibit immune cells expressing the receptors, can be assayed by any means known in the art and described herein, including, but not limited to, reporter assays and cytotoxicity assays.

As used herein, "activation" of an immune cell or an immune cell that is "activated" is an immune cell that can carry out one or more functions characteristic of an immune response. These functions include proliferation, release of cytokines, and cytotoxicity, i.e. killing of a target cell. Activated immune cells express markers that will be apparent to persons of skill in the art. For example, activated T cells can express one or more of CD69, CD71, CD25 and HLA-DR. An immune cell expressing an activator receptor (e.g. a CEA CAR) can be activated by the activator receptor when it becomes responsive to the binding of the receptor to a target antigen (e.g. CEA) expressed by the target cell. A "target antigen" can also be referred to as an "activator antigen" and may be isolated or expressed by a target cell. Activation of an immune cell expressing an inhibitory receptor can be prevented when the inhibitory receptor becomes responsive to the binding of a non-target antigen (e.g. HLA-A*02), even when the activator receptor is bound to the target activator ligand. A "non-target antigen" can also be referred to as an "inhibitory ligand" or a "blocker", and may be isolated or expressed by a target cell.

Receptor expression on an immune cell can be verified by assays that report the presence of the activator receptors and inhibitory receptors described herein. For example, a population of immune cells can be stained with a labeled molecule (e.g. a fluorophore labeled receptor-specific antibody or a fluorophore-labeled receptor-specific ligand), and quantified using fluorescence activated cell sorting (FACS) flow cytometry. This method allows a percentage of immune cells in a population of immune cells to be characterized as expressing an activator receptor, an inhibitory receptor, or both receptors. The ratio of activator receptor and inhibitory receptors expressed by the immune cells described herein can be determined by, for example, digital droplet PCR. These approaches can be used to characterize the population of cells for the production and manufacturing of the immune cells, pharmaceutical compositions, and kits described herein. For the immune cells, pharmaceutical compositions, and kits described herein, it is understood that a suitable percentage of immune cells expressing both an activator receptor and an inhibitory receptor is determined specifically for the methods described herein. For example, a suitable percentage of immune cells expressing both an activator receptor and in inhibitory receptor can be at least 50%, at least 55%, at least 60%, at least 65%, at least 70%, at least 75%, at least 80%, at least 85%, at least 90%, or at least 95%. For example, a suitable percentage of immune cells expressing both an activator receptor and an inhibitory receptor can be at most 50%, at most 55%, at most 60%, at most 65%, at most 70%, at most 75%, at most 80%, at most 85%, at most 90%, or at most 95%. For example, a suitable ratio of activator receptor and inhibitory receptor in an immune cell can be about 5:1, about 4:1, about 3:1, about 2:1, about 1:1, about 1:2, about 1:3, about 1:4, or about 1:5. It is understood that purification, enrichment, and/or depletion steps can be used on populations of immune cells to meet suitable values for the immune cells, pharmaceutical compositions, and kits described herein.

A responsive receptor expressed by the immune cells described herein can be verified by assays that measure the generation of a signal expected to be generated by the intracellular domain of the receptor. Reporter cell lines, such as Jurkat-Luciferase NFAT cells (Jurkat cells), can be used to characterize a responsive receptor. Jurkat cells are derived from T cells and comprise a stably integrated nuclear factor of activated T-cells (NFAT)-inducible luciferase reporter system. NFAT is a family of transcription factors required for immune cell activation, whose activation can be used as a signaling marker for T cell activation. Jurkat cells can be transduced or transfected with the activator receptors and/or inhibitory receptors described herein. The activator receptor is responsive to the binding of a ligand if the Jurkat cell expresses a luciferase reporter gene, and the level of responsiveness can be determined by the level of reporter gene expression. The presence of luciferase can be determined using any known luciferase detection reagent, such as luciferin. An inhibitory receptor is responsive to the binding of a ligand if, when co-expressed with an activator receptor in Jurkat cells, it prevents a normally responsive immune cell from expressing luciferase in response to the activator receptor. For example, the responsiveness of an inhibitory receptor can be determined and quantified in a Jurkat cell expressing both an activator and an inhibitor by observing the following: 1) the Jurkat cell expresses luciferase in the presence of activator receptor ligand and absence of inhibitory receptor ligand; and 2) luciferase expression in the Jurkat cell is reduced or eliminated in the presence of both an activator receptor ligand and an inhibitory receptor ligand. This approach can be used to determine the sensitivity, potency, and selectivity of activator receptors and specific pairs of activator receptors and inhibitory receptors. The sensitivity, potency, and selectivity can be quantified by EC50 or IC50 values using dose-response experiments, where an activator receptor ligand and/or inhibitory receptor ligand is titrated into a culture of Jurkat cells expressing an activator receptor or a specific pair of activator and inhibitory receptors. Alternatively, the EC50 and IC50 values can be determined in a co-culture of immune cells (e.g. Jurkat cells or primary immune cells) expressing an activator receptor or a specific pair of activator and inhibitory receptors and target cells expressing an increasing amount of an activator ligand or inhibitor ligand. An increasing amount of activator ligand or inhibitor ligand can be accomplished in the target cell by, for example, titration of activator ligand or inhibitor ligand encoding mRNA into target cells, or use of target cells that naturally express different levels of the target ligands. Exemplary suitable EC50 and IC50 values for the activator and inhibitory receptors as determined used target cells expressing varying amounts of the target and non-target ligands include an EC50 of 260 transcripts per million (TPM) or less for the activator receptor, for example an EC50 of between 10 and 260 TPM, and an IC50 of 10 TPM or less for the inhibitory receptor, for example an IC50 of 1-5 TPM.

Activation of the immune cells described herein that express an activator receptor or specific pairs of activator and inhibitory receptors can be further determined by assays that measure the viability of a target cell following co-incubation with said immune cells. The immune cells, sometimes referred to as effector cells, are co-incubated with target cells that express an activator receptor ligand, an inhibitory receptor ligand, or both an activator and inhibitory receptor ligand. Following co-incubation, viability of the target cell is measured using any method to measure viability in a cell culture. For example, viability can be determined using a mitochondrial function assay that uses a tetrazolium salt substrate to measure active mitochondrial enzymes. Viability can also be determined using imaging based methods. Target cells can express a fluorescent protein, such as green fluorescent protein or red fluorescent protein. Reduction in total cell fluorescence indicates a reduction in viability of the target cell. A reduction in viability of the target cell following incubation with immune cells expressing an activator receptor or a specific pair of activator and inhibitory receptors is interpreted as target cell-mediated activation of the immune cell. A measure of the selectivity of the immune cells can also be determined using this approach. The immune cell expressing a pair of activator and inhibitory receptors is selective if the following is observed: 1) viability is reduced in target cells expressing the activator receptor ligand but not the inhibitory receptor ligand; 2) viability is not reduced in target cells expressing both an activator receptor ligand and an inhibitory receptor ligand. From these measurements, a "specific killing" value can be derived that quantifies the percentage of immune cell activation based on the reduction in viability of target cell as a percentage of a negative control (immune cells that do not express an activator receptor). Further, from these measurements a "selectivity ratio" value can be derived that represents the ratio of the specific killing observed in target cells expressing an activator receptor ligand in the absence of inhibitory receptor ligand to the specific killing observed in target cells expressing both an activator receptor ligand and an inhibitory receptor ligand. This approach can be used to characterize the population of cells for the production and manufacturing of the immune cells, pharmaceutical compositions, and kits described herein.

A suitable specific killing value for the immune cells, pharmaceutical compositions, and kits can be, for example, the following criteria: 1) at least 40%, at least 50%, at least 60%, at least 70%, at least 80%, at least 90%, at least 95%, at least 97% or at least 99% specific killing following a 48 hour co-incubation of immune cells and target cells expressing activator receptor ligand in the absence of inhibitory receptor ligand; and 2) less than or equal to 40%, less than or equal to 35%, less than or equal to 30%, less than or equal to 25%, less than or equal to 20%, less than or equal to 15%, less than or equal to 10%, less than or equal to 5%, less than or equal to 3% or less than or equal to 1% specific killing of target cell expressing both an activator receptor ligand and an inhibitory receptor ligand.

As a further example, a suitable specific killing value for the immune cells, pharmaceutical compositions and kits can be the following criteria: 1) between 30% and 99%, between 40% and 99%, between 50% and 99%, between 55% and 95%, between 60% and 95%, between 60% and 90%, between 50% and 80%, between 50% and 70% or between 50% and 60% of target cells expressing the activator ligand but not the inhibitor ligand are killed; and 2), between 1% and 40%, between 3% and 40%, between 5% and 40%, between 5% and 30%, between 10% and 30%, between 15% and 30% or between 5% and 20% of target cells expressing the activator ligand and the inhibitor ligand are killed.

As a still further example, a suitable specific killing value for the immune cells, pharmaceutical compositions, and kits can be, for example, the following criteria: 1) at least 50% specific killing following a 48 hour co-incubation of immune cells and target cells expressing activator receptor ligand in the absence of inhibitory receptor ligand; and 2) less than or equal to 20% specific killing of target cell expressing both an activator receptor ligand and an inhibitory receptor ligand. As a further example, the immune cells are capable of killing at least 30%, at least 40%, at least 50%, at least 60%, at least 70%, at least 80%, at least 90%, at least 95%, at least 97% or at least 99% of target cells expressing the activator ligand and not the inhibitor ligand over a period of 6 hours, 12 hours, 18 hours, 24 hours, 30 hours, 36 hours, 42 hours, 48 hours, 54 hours, or 60 hours, while killing less than 40%, less than 30%, less than 20%, less than 10%, less than 5%, less than 3% or less than 1% of target cells expressing the activator and inhibitor ligands over the same time period.

A suitable specific killing value of the target cell expressing an activator ligand in the absence of an inhibitory ligand value for the immune cells, pharmaceutical compositions, and kits can be, for example, at least about 50% to at least about 95%. A suitable specific killing value of the target cell expressing an activator ligand in the absence of an inhibitory ligand value for the immune cells, pharmaceutical compositions, and kits can be, for example, at least about 50%, at least about 55%, at least about 60%, at least about 65%, at least about 70%, at least about 75%, at least about 80%, at least about 85%, at least about 90%, or at least about 95%. A suitable specific killing value of the target cell expressing an activator ligand in the absence of an inhibitory ligand value for the immune cells, pharmaceutical compositions, and kits can be, for example, at most about 50%, at most about 55%, at most about 60%, at most about 65%, at most about 70%, at most about 75%, at most about 80%, at most about 85%, at most about 90%, or at most about 95%. A suitable specific killing value of target cells expressing both an activator receptor ligand and an inhibitory receptor ligand for the immune cells, pharmaceutical compositions, and kits can be can be less than about 50%, less than about 45%, less than about 40%, less than about 35%, less than about 30%, less than about 25%, less than about 20%, less than about 15%, less than about 10%, or less than about 5%. The suitable specific killing value for the immune cells, pharmaceutical compositions, and kits can be can be determined following about 6 hours, about 12 hours, about 18 hours, about 24, about 30 hours, about 36 hours, about 42 hours, about 48 hours, about 54 hours, about 60 hours, about 66 hours, or about 72 hours of co-incubation of immune cells with target cells.

A suitable specific killing value of the target cell expressing an activator ligand in the absence of an inhibitory ligand value for the immune cells, pharmaceutical compositions, and kits can be, for example, at least about 50% to at least about 95%. A suitable specific killing value of the target cell expressing an activator ligand in the absence of an inhibitory ligand value for the immune cells, pharmaceutical compositions, and kits can be, for example, at least about 50%, at least about 55%, at least about 60%, at least about 65%, at least about 70%, at least about 75%, at least about 80%, at least about 85%, at least about 90%, or at least about 95%. A suitable specific killing value of the target cell expressing an activator ligand in the absence of an inhibitory ligand value for the immune cells, pharmaceutical compositions, and kits can be, for example, at most about 50%, at most about 55%, at most about 60%, at most about 65%, at most about 70%, at most about 75%, at most about 80%, at most about 85%, at most about 90%, or at most about 95%. A suitable specific killing value of target cells expressing both an activator receptor ligand and an inhibitory receptor ligand for the immune cells, pharmaceutical compositions, and kits can be can be less than about 50%, less than about 45%, less than about 40%, less than about 35%, less than about 30%, less than about 25%, less than about 20%, less than about 15%, less than about 10%, or less than about 5%. The suitable specific killing value for the immune cells, pharmaceutical compositions, and kits can be can be determined following about 6 hours, about 12 hours, about 18 hours, about 24, about 30 hours, about 36 hours, about 42 hours, about 48 hours, about 54 hours, about 60 hours, about 66 hours, or about 72 hours of co-incubation of immune cells with target cells.

As used herein, the term "functional variant" refers to a protein that has one or more amino-acid substitutions, insertions, or deletions as compared to a parental protein, and which retains one or more desired activities of the parental protein. A functional variant may be a fragment of the protein (i.e. a variant having N- and/or C-terminal deletions) that retain the one or more desired activities of the parental protein.

All publications and patents mentioned herein are hereby incorporated by reference in their entirety as if each individual publication or patent was specifically and individually indicated to be incorporated by reference. In case of conflict, the present application, including any definitions herein, will control. However, mention of any reference, article, publication, patent, patent publication, and patent application cited herein is not, and should not be taken as an acknowledgment, or any form of suggestion, that they constitute valid prior art or form part of the common general knowledge in any country in the world.

Activator Receptors

The disclosure provides a first receptor, comprising a first extracellular ligand binding domain specific to a target antigen comprising a cancer cell-specific antigen, or a peptide antigen thereof in a complex with a major histocompatibility complex class I (MHC-I). The first receptor is an activator receptor, and mediates activation of an immune cell expressing the first receptor upon binding of the target antigen by the extracellular ligand binding domain of the first receptor. The first receptor is responsive to a target antigen (i.e. activator ligand). For example, when a target antigen binds to or contacts the first receptor, the first receptor is responsive and activates an immune cell expressing the first receptor upon binding of the target antigen by the extracellular ligand binding domain of the first receptor. In some embodiments, the first receptor is a chimeric antigen receptor (CAR). In some embodiments, the first receptor is a T cell receptor (TCR).

In some embodiments, the first receptor is humanized. As used herein, "humanized" refers to the replacement of a sequence or a subsequence in a transgene that has been isolated or derived from a non-human species with a homologous, or functionally equivalent, human sequence. For example, a humanized antibody can be created by grafting mouse CDRs into human framework sequences, followed by back substitution of certain human framework residues for the corresponding mouse residues from the source antibody.

Activator Targets

In some embodiments, the target antigen for the first receptor is a cancer cell specific antigen. Any cell surface molecule expressed by the target cancer cells may be a suitable target antigen for the first receptor ligand binding domain. For example, a cell adhesion molecule, a cell-cell signaling molecule, an extracellular domain, a molecule involved in chemotaxis, a glycoprotein, a G protein-coupled receptor, a transmembrane, a receptor for a neurotransmitter or a voltage gated ion channel can be used as a target antigen.

In some embodiments, the target antigen is a peptide antigen of a cancer cell-specific antigen in a complex with a major histocompatibility complex class I (MHC-I). Any molecule expressed by the target cancer cells and presented by the major histocompatibility complex class I (MHC-I) on the cancer cell surface as a peptide antigen (pMHC) may be a suitable target antigen for the first receptor extracellular ligand binding domain.

In some embodiments, the cancer cell-specific antigen is CEA cell adhesion molecule 5 (CEA), or a peptide antigen thereof in a complex with a major histocompatibility complex class I (MHC-I).

The major histocompatibility complex class I (MHC-I) is a protein complex that displays antigens to cells of the immune system, triggering an immune response. The Human Leukocyte Antigens (HLAs) corresponding to MHC-I are HLA-A, HLA-B and HLA-C.

Cancer cell-specific pMHC antigens comprising any of HLA-A, HLA-B, HLA-C, HLA-E, HLA-F or HLA-G are envisaged as within the scope of the disclosure. In some embodiments, the cancer cell-specific antigen comprises HLA-A. HLA-A receptors are heterodimers comprising a heavy α chain and smaller β chain. The α chain is encoded by a variant of HLA-A, while the β chain (β2-microglobulin) is an invariant. There are several thousand variant HLA-A genes, all of which fall within the scope of the instant disclosure. In some embodiments, the MHC-I comprises a human leukocyte antigen A*02 allele (HLA-A*02).

In some embodiments, the cancer cell-specific antigen comprises HLA-B. Hundreds of versions (alleles) of the HLA-B gene are known, each of which is given a particular number (such as HLA-B27).

In some embodiments, the cancer cell-specific antigen comprises HLA-C. HLA-C belongs to the HLA class I heavy chain paralogues. This class I molecule is a heterodimer consisting of a heavy chain and a light chain (beta-2 microglobulin). Over one hundred HLA-C alleles are known in the art.

In some embodiments, the cancer cell-specific antigen is a colorectal cancer antigen. In some embodiments, the colorectal cancer antigen comprises CEA, or a peptide antigen thereof in a complex with a major histocompatibility complex class I (MHC-I).

Figure 7:
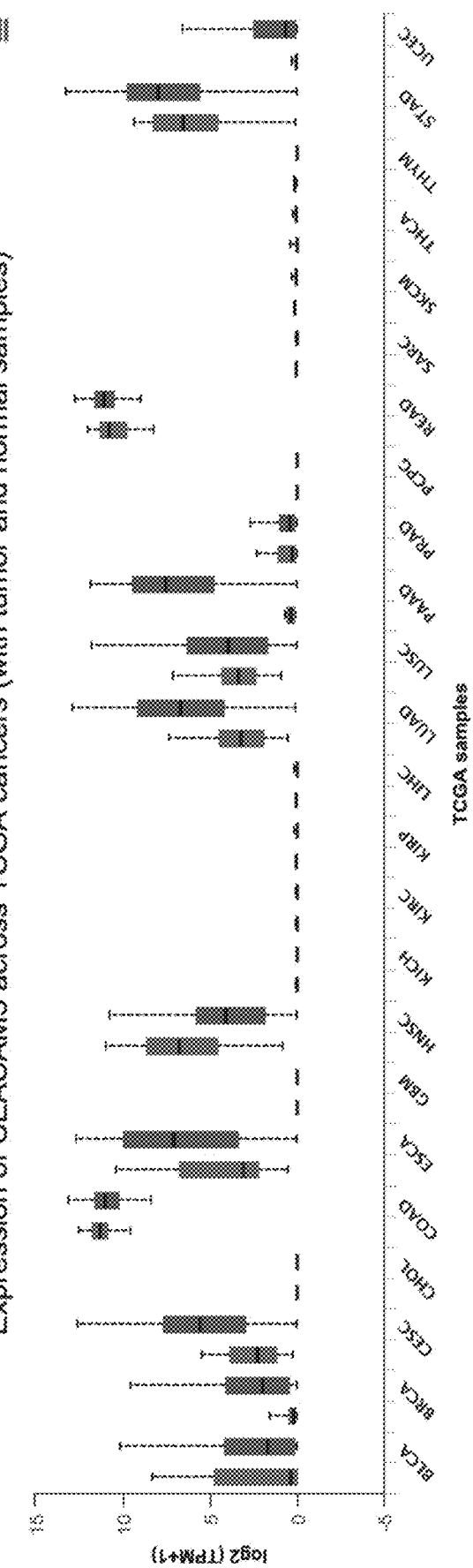
FIG. 7 shows the expression of CEA across all TCGA cancers (with tumor and normal samples. Abbreviations: BLCA (Bladder cancer), BRCA (Breast Cancer), CESC (Cervical squamous cell carcinoma and endocervical adenocarcinoma), CHOL Cholangiocarcinoma), COAD (Colon adenocarcinoma), ESCA (Esophageal carcinoma), GBM (Glioblastoma multiforme), HNSC (Head and Neck squamous cell carcinoma), KICH (Kidney Chromophobe), KIRP (Kidney renal papillary cell carcinoma), LIHC (Liver hepatocellular carcinoma), LUAD (Lung adenocarcinoma), LUSC (Lung squamous cell carcinoma), PAAD (Pancreatic adenocarcinoma), PRAD (Prostate adenocarcinoma), PCPG (Pheochromocytoma and Paraganglioma), READ (Rectum adenocarcinoma), SARC (Sarcoma), SKCM (Skin Cutaneous Melanoma), THCA (Thyroid carcinoma), THYM (Thymoma), STAD (Stomach adenocarcinoma), UCEC (Uterine Corpus Endometrial Carcinoma).
Figure 8:
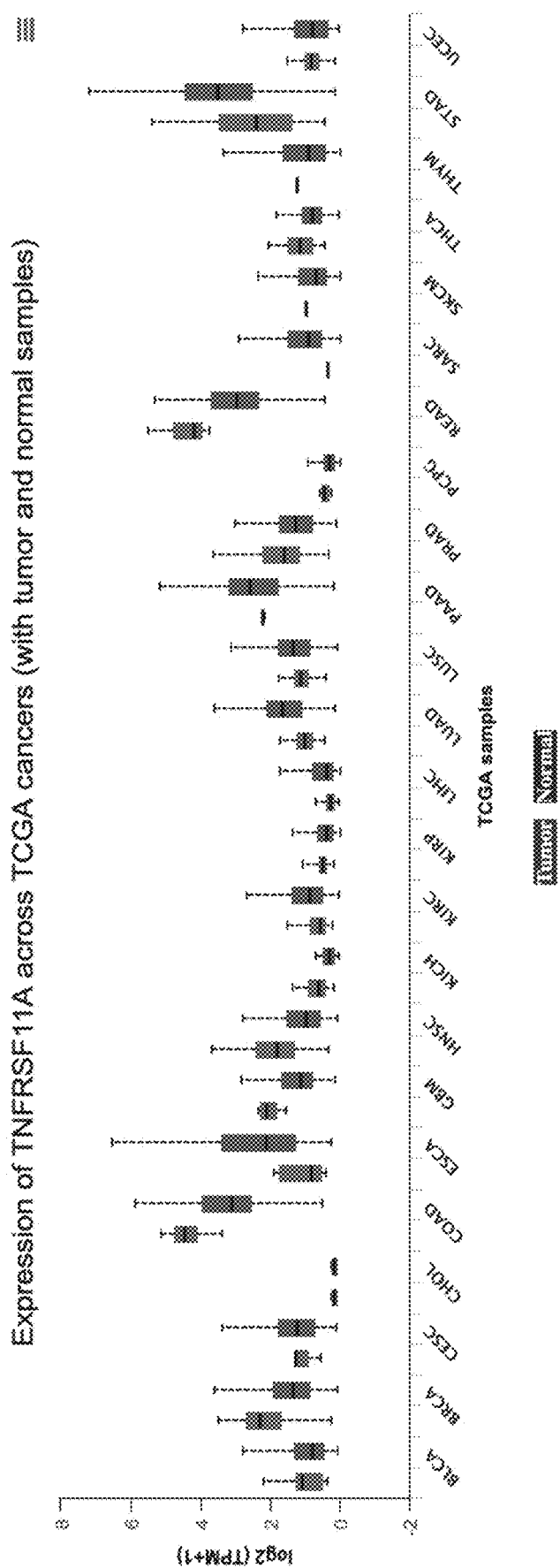
FIG. 8 shows the expression of TNFGSF11A across TCGA cancers (with tumors and normal samples).

In some embodiments, the cancer cell-specific antigen is CEA cell adhesion molecule 5 (CEA), or a peptide antigen thereof in a complex with a major histocompatibility complex class I (MHC-I). CEA is a 180-kDa glycoprotein tumor-associated protein expressed by a variety of cancer cells. CEA is a GPI-anchored adhesion molecule composed of repeated immunoglobulin domains. It is used as a biomarker in colon cancer, both as a diagnostic and as a surrogate for treatment response. Cancers that express CEA include adenocarcinomas, colorectal cancers and selected other epithelial cancers, including colorectal adenocarcinomas. However, CEA is also expressed in a variety of normal epithelial cells throughout the gastrointestinal tract, for example in the highly differentiated epithelial cells in the upper third of colonic crypts (see FIG. 7 for CEA expression).

All isoforms of CEA are envisaged as cancer cell-specific antigens of the disclosure. CEA isoform 1 is described in NCBI record number NP_001278413.1, the contents of which are incorporated by reference herein. In some embodiments, CEA comprises an amino acid sequence of:

```
                                                        (SEQ ID NO: 1)
  1 MESPSAPPHR WCIPWQRLLL TASLLTFWNP PTTAKLTIES TPFNVAEGKE VLLLVHNLPQ

61 HLFGYSWYKG ERVDGNRQII GYVIGTQQAT PGPAYSGREI IYPNASLLIQ NIIQNDTGFY

121 TLHVIKSDLV NEEATGQFRV YPELPKPSIS SNNSKPVEDK DAVAFTCEPE TQDATYLWWV

181 NNQSLPVSPR LQLSNGNRTL TLFNVTRNDT ASYKCETQNP VSARRSDSVI LNVLYGPDAP

241 TISPLNTSYR SGENLNLSCH AASNPPAQYS WFVNGTFQQS TQELFIPNIT VNNSGSYTCQ

301 AHNSDTGLNR TTVTTITVYA EPPKPFITSN NSNPVEDEDA VALTCEPEIQ NTTYLWWVNN

361 QSLPVSPRLQ LSNDNRTLTL LSVTRNDVGP YECGIQNELS VDHSDPVILN VLYGPDDPTI

421 SPSYTYYRPG VNLSLSCHAA SNPPAQYSWL IDGNIQQHTQ ELFISNITEK NSGLYTCQAN

481 NSASGHSRTT VKTITVSAEL PKPSISSNNS KPVEDKDAVA FTCEPEAQNT TYLWWVNGQS

541 LPVSPRLQLS NGNRTLTLFN VTRNDARAYV CGIQNSVSAN RSDPVTLDVL YGPDTPIISP

601 PDSSYLSGAN LNLSCHSASN PSPQYSWRIN GIPQQHTQVL FIAKITPNNN GTYACFVSNL

661 ATGRNNSIVK SITVSASGTS PGLSAGATVG IMIGVLVGVA LI.
```

In some embodiments, CEA comprises a sequence that shares at least 80%, at least 85%, at least 90%, at least 95%, at least 96%, at least 97%, at least 98%, or at least 99% identity to SEQ ID NO: 1. CEA isoform 2 is described in NCBI record number NP_001295327.1, the contents of which are incorporated by reference herein. In some embodiments, CEA comprises an amino acid sequence of:

```
                                                               (SEQ ID NO: 15)
  1 MESPSAPPHR WCIPWQRLLL TASLLTFWNP PTTAKLTIES TPFNVAEGKE VLLLVHNLPQ

61 HLFGYSWYKG ERVDGNRQII GYVIGTQQAT PGPAYSGREI IYPNASLLIQ NIIQNDTGFY

121 TLHVIKSDLV NEEATGQFRV YPELPKPSIS SNNSKPVEDK DAVAFTCEPE TQDATYLWWV

181 NNQSLPVSPR LQLSNGNRTL TLFNVTRNDT ASYKCETQNP VSARRSDSVI LNVLYGPDAP

241 TISPLNTSYR SGENLNLSCH AASNPPAQYS WFVNGTFQQS TQELFIPNIT VNNSGSYTCQ

301 AHNSDTGLNR TTVTTITVYE PPKPFITSNN SNPVEDEDAV ALTCEPEIQN TTYLWWVNNQ

361 SLPVSPRLQL SNDNRTLTLL SVTRNDVGPY ECGIQNELSV DHSDPVILNV LYGPDDPTIS

421 PSYTYYRPGV NLSLSCHAAS NPPAQYSWLI DGNIQQHTQE LFISNITEKN SGLYTCQANN

481 SASGHSRTTV KTITVSAELP KPSISSNNSK PVEDKDAVAF TCEPEAQNTT YLWWVNGQSL

541 PVSPRLQLSN GNRTLTLFNV TRNDARAYVC GIQNSVSANR SDPVTLDVLY GPDTPIISPP

601 DSSYLSGANL NLSCHSASNP SPQYSWRING IPQQHTQVLF IAKITPNNNG TYACFVSNLA

661 TGRNNSIVKS ITVSASGTSP GLSAGATVGI MIGVLVGVAL I.
```

In some embodiments, CEA comprises a sequence that shares at least 80%, at least 85%, at least 90%, at least 95%, at least 96%, at least 97%, at least 98%, or at least 99% identity to SEQ ID NO: 15.

In some embodiments, the cancer cell-specific antigen is a peptide antigen derived from CEA. In some embodiments, the peptide antigen is comprises a sequence having at least 80%, at least 85%, at least 90%, at least 95%, at least 96%, at least 97%, at least 98%, or at least 99% identity to a subsequence of SEQ ID NO: 1. In some embodiments, the peptide antigen comprises a sequence identical to a subsequence of SEQ ID NO: 1. Exemplary CEA peptide antigens include amino acids 691-699 of SEQ ID NO: 1 (IMIGVLVGV), amino acids 605-613 of SEQ ID NO: 1 (YLSGANLNL), and amino acids 694-702 of SEQ ID NO: 1 (GVLVGVALI). In some embodiments the CEA peptide antigen comprises, or consists essentially of, amino acids 691-699 of SEQ ID NO: 1 (IMIGVLVGV). In some embodiments, the peptide antigen is comprises a sequence having at least 80%, at least 85%, at least 90%, at least 95%, at least 96%, at least 97%, at least 98%, or at least 99% identity to a subsequence of SEQ ID NO: 15. In some embodiments, the peptide antigen comprises a sequence identical to a subsequence of SEQ ID NO: 15. In some embodiments, the CEA peptide antigen is complexed with MHC-I. In some embodiments, the MHC-I comprises a human leukocyte antigen A*02 allele (HLA-A*02).

Extracellular Ligand Binding Domain

The disclosure provides a first receptor, comprising a first extracellular ligand binding domain specific to a target antigen. In some embodiments, the target antigen comprises a cancer cell-specific antigen.

In some embodiments, the cancer cell-specific antigen is CEA or a CEA-derived peptide antigen complexed with MHC-I, and the ligand binding domain of the first receptor recognizes and binds to the CEA antigen.

Any type of ligand binding domain that can regulate the activity of a receptor in a ligand dependent manner is envisaged as within the scope of the instant disclosure. In some embodiments, the ligand binding domain is an antigen binding domain. Exemplary antigen binding domains include, inter alia, scFv, SdAb, Vβ-only domains, and TCR antigen binding domains derived from the TCR α and β chain variable domains.

Any type of antigen binding domain is envisaged as within the scope of the instant disclosure.

For example, the first extracellular ligand binding domain may be part of a contiguous polypeptide chain including, for example, a Vβ-only domain, a single domain antibody fragment (sdAb) or heavy chain antibodies HCAb, a single chain antibody (scFv) derived from a murine, humanized or human antibodies (Harlow et al., 1999, In: Using Antibodies: A Laboratory Manual, Cold Spring Harbor Laboratory Press, N.Y.; Harlow et al., 1989, In: Antibodies: A Laboratory Manual, Cold Spring Harbor, N.Y.; Houston et al., 1988, Proc. Natl. Acad. Sci. USA 85:5879-5883; Bird et al., 1988, Science 242:423-426). In some aspects, the first extracellular ligand binding domain comprises an antigen binding domain that comprises an antibody fragment. In further aspects, the first extracellular ligand binding domain comprises an antibody fragment that comprises a scFv or an sdAb.

The term "antibody," as used herein, refers to a protein, or polypeptide sequences derived from an immunoglobulin molecule, which specifically binds to an antigen. Antibodies can be intact immunoglobulins of polyclonal or monoclonal origin, or fragments thereof and can be derived from natural or from recombinant sources.

The terms "antibody fragment" or "antibody binding domain" refer to at least one portion of an antibody, or recombinant variants thereof, that contains the antigen binding domain, i.e., an antigenic determining variable region of an intact antibody, that is sufficient to confer recognition and specific binding of the antibody fragment to a target, such as an antigen and its defined epitope. Examples of antibody fragments include, but are not limited to, Fab, Fab', F(ab')2, and Fv fragments, single-chain (sc)Fv ("scFv") antibody fragments, linear antibodies, single domain antibodies (abbreviated "sdAb") (either VL or VH), camelid VHH domains, and multi-specific antibodies formed from antibody fragments.

The term "scFv" refers to a fusion protein comprising at least one antibody fragment comprising a variable region of a light chain and at least one antibody fragment comprising a variable region of a heavy chain, wherein the light and heavy chain variable regions are contiguously linked via a short flexible polypeptide linker, and capable of being expressed as a single polypeptide chain, and wherein the scFv retains the specificity of the intact antibody from which it is derived.

"Heavy chain variable region" or "VH" (or, in the case of single domain antibodies, e.g., nanobodies, "VHH") with regard to an antibody refers to the fragment of the heavy chain that contains three CDRs interposed between flanking stretches known as framework regions, these framework regions are generally more highly conserved than the CDRs and form a scaffold to support the CDRs.

Unless specified, as used herein a scFv may have the VL and VH variable regions in either order, e.g., with respect to the N-terminal and C-terminal ends of the polypeptide, the scFv may comprise VL-linker-VH or may comprise VH-linker-VL.

In some embodiments, the antigen binding domain of the activator and/or inhibitory receptor comprises an scFv. In some embodiments, the scFv comprises a VL and VH region joined by a linker. In some embodiments, the linker comprises a glycine serine linker, for example GGGGSGGGGSGGGGSGG (SEQ ID NO: 146). In some embodiments, the scFv further comprises a signal sequence at the N terminus of the scFv. Exemplary signal sequences include MDMRVPAQLLGLLLLWLRGARC (SEQ ID NO: 184), which is encoded by

```
                                         (SEQ ID NO: 185)
ATGGACATGAGGGTCCCCGCTCAGCTCCTGGGGCTCCTGCTACTCTGGCT

CCGAGGTGCCAGATGT.
```

The term "antibody light chain," refers to the smaller of the two types of polypeptide chains present in antibody molecules in their naturally occurring conformations. Kappa ("κ") and lambda ("λ") light chains refer to the two major antibody light chain isotypes.

The term "recombinant antibody" refers to an antibody that is generated using recombinant DNA technology, such as, for example, an antibody expressed by a bacteriophage or yeast expression system. The term should also be construed to mean an antibody which has been generated by the synthesis of a DNA molecule encoding the antibody and which DNA molecule expresses an antibody protein, or an amino acid sequence specifying the antibody, wherein the DNA or amino acid sequence has been obtained using recombinant DNA or amino acid sequence technology which is available and well known in the art.

The term "Vβ domain", "Vβ-only domain", "β chain variable domain" or "single variable domain TCR (svd-TCR)" refers to an antigen binding domain that consists essentially of a single T Cell Receptor (TCR) beta variable domain that specifically binds to an antigen in the absence of a second TCR variable domain. The Vβ-only domain engages antigen using complementarity-determining regions (CDRs). Each Vβ-only domain contains three complement determining regions (CDR1, CDR2, and CDR3). Additional elements may be combined provided that the Vβ domain is configured to bind the epitope in the absence of a second TCR variable domain.

In some embodiments, the extracellular ligand binding domain of the first receptor comprises an antibody fragment, a single chain Fv antibody fragment (scFv), or a β chain variable domain (Vβ).

In some embodiments, the extracellular ligand binding domain of the first receptor comprises a TCR α chain variable domain and a TCR β chain variable domain.

In some embodiments, the first extracellular ligand binding domain comprises a TCR ligand binding domain that binds to a CEA antigen. In some embodiments, the CEA antigen is complexed with MHC-I, and the MHC-I comprises an HLA-A*02 allele. Exemplary TCR antigen binding domains that bind to and recognize CEA MHC-I HLA-A*02 antigens are described in Parkhurst et al. Molecular Therapy 2011 19(3): P620-626, the contents of which are incorporated herein by reference. An exemplary TCR extracellular ligand binding domain that recognizes amino acids 691-699 of SEQ ID NO: 1 (IMIGVLVGV) complexed with HLA-A*02 MHC-I comprises a TCR alpha domain of TRAV8-1*01 and TRAJ6*01, and a TCR beta domain of TRBV26*01, TRBD1*01, TRBJ2-7*01 and TRBC2.

Exemplary CDRs for that recognize a CEA MHC-I HLA-A*02 antigen comprising IMIGVLVGV (SEQ ID NO: 2) are shown in Table 1 below.

TABLE 1

| | \multicolumn{7}{c|}{CDRs for MHC-I HLA-A*02 + CEA (IMIGVLVGV (SEQ ID NO: 2))} | |
|---|---|---|---|---|---|---|---|
| | A-CDR1 | A-CDR2 | A-CDR3 | B-CDR1 | B-CDR2 | B-CDR3 | Note |
| 1 | TSITA (SEQ ID NO: 3) | IRSNER (SEQ ID NO: 4) | ATDLTSGGNYK (SEQ ID NO: 5) | KGHPV (SEQ ID NO: 9) | FQNQEV (SEQ ID NO: 10) | ASSLGLGDYEQ (SEQ ID NO: 11) | "WT" |
| 2 | | | | | | ASSLGTGDYEQ (SEQ ID NO: 12) | BV117T |
| 3 | | | ATDFTSGGNYK (SEQ ID NO: 6) | | | ASSLGLGDYEQ (SEQ ID NO: 11) | AL-L110F |
| 4 | | | | | | ASSLGTGDYEQ (SEQ ID NO: 12) | AV-L110F/ BV117T |
| 5 | | | ATDLTTGGNYK (SEQ ID NO: 7) | | | ASSLGLGDYEQ (SEQ ID NO: 11) | AV-S112T |

TABLE 1-continued

CDRs for MHC-I HLA-A*02 + CEA (IMIGVLVGV (SEQ ID NO: 2))

| | A-CDR1 | A-CDR2 | A-CDR3 | B-CDR1 | B-CDR2 | B-CDR3 | Note |
|---|---|---|---|---|---|---|---|
| 6 | | | | | | ASSLGTGDYEQ (SEQ ID NO: 12) | AV-S112T/ BV117T |
| 7 | | | ATDFTTGGNYK (SEQ ID NO: 8) | | | ASSLGLGDYEQ (SEQ ID NO: 11) | AV-L110FS112T |
| 8 | | | | | | ASSLGTGDYEQ (SEQ ID NO: 12) | AV-L110FS112T/ BV117T |

In some embodiments, the first extracellular ligand binding domain comprises complement determining regions (CDRs) selected from SEQ ID NOs: 3-12 or sequences having at least 85% or at least 95% identity thereto.

In some embodiments, the ligand binding domain of the first receptor comprises a TCR ligand binding domain. In some embodiments, the TCR α chain variable domain comprises a CDR-1 of TSITA (SEQ ID NO: 3), a CDR-2 of IRSNER (SEQ ID NO: 4) and a CDR-3 comprising ATDLTSGGNYK (SEQ ID NO: 5), ATDFTSGGNYK (SEQ ID NO: 6), ATDLTTGGNYK (SEQ ID NO: 7) or ATDFTTGGNYK (SEQ ID NO: 8); and the TCR β chain variable domain comprises a CDR-1 of KGHPV (SEQ ID NO: 9), a CDR-2 of FQNQEV (SEQ ID NO: 10), and a CDR-3 of ASSLGLGDYEQ (SEQ ID NO: 11) or ASSLGTGDYEQ (SEQ ID NO: 12), or sequences having at least 85% or at least 95% identity thereto. In some embodiments, the TCR α chain variable domain comprises a CDR-1 of SEQ ID NO: 9, a CDR-2 of SEQ ID NO: 10 and a CDR-3 of SEQ ID NO: 11 or SEQ ID NO: 12; and the TCR β chain variable domain comprises a CDR-1 of SEQ ID NO: 3, a CDR-2 of SEQ ID NO: 4 and a CDR-3 comprising SEQ ID NO: 5, SEQ ID NO: 6, SEQ ID NO: 7 or SEQ ID NO: 8, or sequences having at least 85% or at least 95% identity thereto. 01701 Exemplary TCR alpha and beta chains comprising the CDRs from Table 1 are shown in Table 2 below. CDRs are underlined in the sequences in Table 2. In Table 2, the TCR alpha and TCR beta chains are separated by a P2A self-cleaving peptide

TABLE 2

MHC-I HLA-A*02 + CEA (IMIGVLVGV (SEQ ID NO: 2)) TCR sequences

| Construct | Amino Acid Sequence | DNA Sequence |
|---|---|---|
| CT 548: pLenti 1 CEA TCR TRAV8-1*01 118P & 119T with murine constant region | MHSLLGLLMVSLWLQLTRVNSQLAEENPWALSVHEGESVTVNCSYK<u>TSITA</u>LQ WYRQKSGEGPAQLIL<u>IRSNER</u>EKRNGRLRATLDTSSQSSSLSITATRCEDTAV YFC<u>ATDLTSGGNYK</u>PTFGKGTSLVVHPDIQNPEPAVYQLKDPRSQDSTLCFT DFDSQINVPKTMESGTFITDKTVLDMKAMDSKSNGAIAWSNQTSFTCQDIFKE TNATYPSSDVPCDATLTEKSFETDMNLNFQNLSVMGLRILLLKVAGFNLLMTL RLWSSGSGATNFSLLKQAGDVEENPGPMATRLLCYTVLCLLGARILNSKVIQT PRYLVKGQGQKAKMRCIPE<u>KGHPV</u>VFWYQQNKNNEFKFLIN<u>FQNQEV</u>LQQIDM TEKRFSAECPSNSPCSLEIQSSEAGDSALYL<u>CASSLGLGDYEQ</u>YFGPGTRLTV LEDLRNVTPPKVSLFEPSKAEIANKQKATLVCLARGFFPDHVELSWWVNGKEV HSGVSTDPQAYKESNYSYCLSSRLRVSATFWHNPRNHFRCQVQFHGLSEEDKW PEGSPKPVTQNISAEAWGRADCGITSASYQQGVLSATILYEILLGKATLYAVL VSTLVVMAMVKRKNS (SEQ ID NO: 16) | (SEQ ID NO: 187) |
| CT 549: pLenti 1 CEA TCR TRAV8-1*01 118P & 119T TRBV26*01 L117T with murine constant region | MHSLLGLLMVSLWLQLTRVNSQLAEENPWALSVHEGESVTVNCSYK<u>TSITA</u>LQ WYRQKSGEGPAQLIL<u>IRSNER</u>EKRNGRLRATLDTSSQSSSLSITATRCEDTAV YFC<u>ATDLTSGGNYK</u>PTFGKGTSLVVHPDIQNPEPAVYQLKDPRSQDSTLCFT DFDSQINVPKTMESGTFITDKTVLDMKAMDSKSNGAIAWSNQTSFTCQDIFKE TNATYPSSDVPCDATLTEKSFETDMNLNFQNLSVMGLRILLLKVAGFNLLMTL RLWSSGSGATNFSLLKQAGDVEENPGPMATRLLCYTVLCLLGARILNSKVIQT PRYLVKGQGQKAKMRCIPE<u>KGHPV</u>VFWYQQNKNNEFKFLIN<u>FQNQEV</u>LQQIDM TEKRFSAECPSNSPCSLEIQSSEAGDSALYL<u>CASSLGTGDYEQ</u>YFGPGTRLTV LEDLRNVTPPKVSLFEPSKAEIANKQKATLVCLARGFFPDHVELSWWVNGKEV HSGVSTDPQAYKESNYSYCLSSRLRVSATFWHNPRNHFRCQVQFHGLSEEDKW PEGSPKPVTQNISAEAWGRADCGITSASYQQGVLSATILYEILLGKATLYAVL VSTLVVMAMVKRKNS (SEQ ID NO: 17) | (SEQ ID NO: 188) |
| CT 550: pLenti 1 CEA TCR TRAV8-1*01 118P & 119T with murine constant region | MHSLLGLLMVSLWLQLTRVNSQLAEENPWALSVHEGESVTVNCSYK<u>TSITA</u>LQ WYRQKSGEGPAQLIL<u>IRSNER</u>EKRNGRLRATLDTSSQSSSLSITATRCEDTAV YFC<u>ATDLTSGGNYK</u>PTFGKGTSLVVHPNIQNPEPAVYQLKDPRSQDSTLCFT DFDSQINVPKTMESGTFITDKCVLDMKAMDSKSNGAIAWSNQTSFTCQDIFKE TNATYPSSDVPCDATLTEKSFETDMNLNFQNLLVIVLRILLLKVAGFNLLMTL RLWSSGSGATNFSLLKQAGDVEENPGPMATRLLCYTVLCLLGARILNSKVIQT PRYLVKGQGQKAKMRCIPE<u>KGHPV</u>VFWYQQNKNNEFKFLIN<u>FQNQEV</u>LQQIDM TEKRFSAECPSNSPCSLEIQSSEAGDSALYL<u>CASSLGLGDYEQ</u>YFGPGTRLTV LEDLRNVTPPKVSLFEPSKAEIANKQKATLVCLARGFFPDHVELSWWVNGKEV HSGVCTDPQAYKESNYSYCLSSRLRVSATFWHNPRNHFRCQVQFHGLSEEDKW PEGSPKPVTQNISAEAWGRADCGITSASYQQGVLSATILYEILLGKATLYAVL VSTLVVMAMVKRKNS (SEQ ID NO: 18) | (SEQ ID NO: 189) |

TABLE 2-continued

MHC-I HLA-A*02 + CEA (IMIGVLVGV (SEQ ID NO: 2)) TCR sequences

| Construct | Amino Acid Sequence | DNA Sequence |
|---|---|---|
| CT 551: pLenti 1 CEA TCR TRAV8-1*01 L110F 118P & 119T with murine constant region | MHSLLGLLMVSLWLQLTRVNSQLAEENPWALSVHEGESVTVNCSYK<u>TSITALQ</u> WYRQKSGEGPAQLIL<u>IRSNERE</u>KRNGRLRATLDTSSQSSSLSITATRCEDTAV YFC<u>ATDFTSGGNYK</u>PTFGKGTSLVVHPDIQNPEPAVYQLKDPRSQDSTLCLFT DFDSQINVPKTMESGTFITDKTVLDMKAMDSKSNGAIAWSNQTSFTCQDIFKE TNATYPSSDVPCDATLTEKSFETDMNLNFQNLSVMGLRILLLKVAGFNLLMTL RLWSSGSGATNFSLLKQAGDVEENPGPMATRLLCYTVLCLLGARILNSKVIQT PRYLVKGQGQKAKMRCIPE<u>KGHPVV</u>FWYQQNKNNEFKFLIN<u>FQNQEV</u>LQQIDM TEKRFSAECPSNSPCSLEIQSSEAGDSALYLC<u>ASSLGLGDYEQ</u>YFGPGTRLTV LEDLRNVTPPKVSLFEPSKAEIANKQKATLVCLARGFFPDHVELSWWVNGKEV HSGVSTDPQAYKESNYSYCLSSRLRVSATFWHNPRNHFRCQVQFHGLSEEDKW PEGSPKPVTQNISAEAWGRADCGITSASYQQGVLSATILYEILLGKATLYAVL VSTLVVMAMVKRKNS (SEQ ID NO: 19) | (SEQ ID NO: 190) |
| CT 552: pLenti 1 CEA TCR TRAV8-1*01 S112T 118P & 119T with murine constant region | MHSLLGLLMVSLWLQLTRVNSQLAEENPWALSVHEGESVTVNCSYK<u>TSITALQ</u> WYRQKSGEGPAQLIL<u>IRSNERE</u>KRNGRLRATLDTSSQSSSLSITATRCEDTAV YFC<u>ATDLTTGGNYK</u>PTFGKGTSLVVHPDIQNPEPAVYQLKDPRSQDSTLCLFT DFDSQINVPKTMESGTFITDKTVLDMKAMDSKSNGAIAWSNQTSFTCQDIFKE TNATYPSSDVPCDATLTEKSFETDMNLNFQNLSVMGLRILLLKVAGFNLLMTL RLWSSGSGATNFSLLKQAGDVEENPGPMATRLLCYTVLCLLGARILNSKVIQT PRYLVKGQGQKAKMRCIPE<u>KGHPVV</u>FWYQQNKNNEFKFLIN<u>FQNQEV</u>LQQIDM TEKRFSAECPSNSPCSLEIQSSEAGDSALYLC<u>ASSLGLGDYEQ</u>YFGPGTRLTV LEDLRNVTPPKVSLFEPSKAEIANKQKATLVCLARGFFPDHVELSWWVNGKEV HSGVSTDPQAYKESNYSYCLSSRLRVSATFWHNPRNHFRCQVQFHGLSEEDKW PEGSPKPVTQNISAEAWGRADCGITSASYQQGVLSATILYEILLGKATLYAVL VSTLVVMAMVKRKNS (SEQ ID NO: 20) | (SEQ ID NO: 191) |
| CT 553: pLenti 1 CEA TCR TRAV8-1*01 L110F S112T 118P & 119T with murine constant region | MHSLLGLLMVSLWLQLTRVNSQLAEENPWALSVHEGESVTVNCSYK<u>TSITALQ</u> WYRQKSGEGPAQLIL<u>IRSNERE</u>KRNGRLRATLDTSSQSSSLSITATRCEDTAV YFC<u>ATDFTTGGNYK</u>PTFGKGTSLVVHPDIQNPEPAVYQLKDPRSQDSTLCLFT DFDSQINVPKTMESGTFITDKTVLDMKAMDSKSNGAIAWSNQTSFTCQDIFKE TNATYPSSDVPCDATLTEKSFETDMNLNFQNLSVMGLRILLLKVAGFNLLMTL RLWSSGSGATNFSLLKQAGDVEENPGPMATRLLCYTVLCLLGARILNSKVIQT PRYLVKGQGQKAKMRCIPE<u>KGHPVV</u>FWYQQNKNNEFKFLIN<u>FQNQEV</u>LQQIDM TEKRFSAECPSNSPCSLEIQSSEAGDSALYLC<u>ASSLGLGDYEQ</u>YFGPGTRLTV LEDLRNVTPPKVSLFEPSKAEIANKQKATLVCLARGFFPDHVELSWWVNGKEV HSGVSTDPQAYKESNYSYCLSSRLRVSATFWHNPRNHFRCQVQFHGLSEEDKW PEGSPKPVTQNISAEAWGRADCGITSASYQQGVLSATILYEILLGKATLYAVL VSTLVVMAMVKRKNS (SEQ ID NO: 21) | (SEQ ID NO: 192) |
| CT 554: pLenti 1 CEA TCR TRAV8-1*01 L110F 118P & 119T TRBV26*01 L117T with murine constant region | MHSLLGLLMVSLWLQLTRVNSQLAEENPWALSVHEGESVTVNCSYK<u>TSITALQ</u> WYRQKSGEGPAQLIL<u>IRSNERE</u>KRNGRLRATLDTSSQSSSLSITATRCEDTAV YFC<u>ATDFTSGGNYK</u>PTFGKGTSLVVHPDIQNPEPAVYQLKDPRSQDSTLCLFT DFDSQINVPKTMESGTFITDKTVLDMKAMDSKSNGAIAWSNQTSFTCQDIFKE TNATYPSSDVPCDATLTEKSFETDMNLNFQNLSVMGLRILLLKVAGFNLLMTL RLWSSGSGATNFSLLKQAGDVEENPGPMATRLLCYTVLCLLGARILNSKVIQT PRYLVKGQGQKAKMRCIPE<u>KGHPVV</u>FWYQQNKNNEFKFLIN<u>FQNQEV</u>LQQIDM TEKRFSAECPSNSPCSLEIQSSEAGDSALYLC<u>ASSLGTGDYEQ</u>YFGPGTRLTV LEDLRNVTPPKVSLFEPSKAEIANKQKATLVCLARGFFPDHVELSWWVNGKEV HSGVSTDPQAYKESNYSYCLSSRLRVSATFWHNPRNHFRCQVQFHGLSEEDKW PEGSPKPVTQNISAEAWGRADCGITSASYQQGVLSATILYEILLGKATLYAVL VSTLVVMAMVKRKNS (SEQ ID NO: 22) | (SEQ ID NO: 193) |
| CT 555: pLenti 1 CEA TCR TRAV8-1*01 S112T 118P & 119T TRBV26*01 L117T with murine constant region | MHSLLGLLMVSLWLQLTRVNSQLAEENPWALSVHEGESVTVNCSYK<u>TSITALQ</u> WYRQKSGEGPAQLIL<u>IRSNERE</u>KRNGRLRATLDTSSQSSSLSITATRCEDTAV YFC<u>ATDLTTGGNYK</u>PTFGKGTSLVVHPDIQNPEPAVYQLKDPRSQDSTLCLFT DFDSQINVPKTMESGTFITDKTVLDMKAMDSKSNGAIAWSNQTSFTCQDIFKE TNATYPSSDVPCDATLTEKSFETDMNLNFQNLSVMGLRILLLKVAGFNLLMTL RLWSSGSGATNFSLLKQAGDVEENPGPMATRLLCYTVLCLLGARILNSKVIQT PRYLVKGQGQKAKMRCIPE<u>KGHPVV</u>FWYQQNKNNEFKFLIN<u>FQNQEV</u>LQQIDM TEKRFSAECPSNSPCSLEIQSSEAGDSALYLC<u>ASSLGTGDYEQ</u>YFGPGTRLTV LEDLRNVTPPKVSLFEPSKAEIANKQKATLVCLARGFFPDHVELSWWVNGKEV HSGVSTDPQAYKESNYSYCLSSRLRVSATFWHNPRNHFRCQVQFHGLSEEDKW PEGSPKPVTQNISAEAWGRADCGITSASYQQGVLSATILYEILLGKATLYAVL VSTLVVMAMVKRKNS (SEQ ID NO: 23) | (SEQ ID NO: 194) |

TABLE 2-continued

MHC-I HLA-A*02 + CEA (IMIGVLVGV (SEQ ID NO: 2)) TCR sequences

| Construct | Amino Acid Sequence | DNA Sequence |
|---|---|---|
| CT 556: pLenti 1 CEA TCR TRAV8-1*01 L110F S112T 118P & 119T TRBV26*01 L117T with murine constant region | MHSLLGLLMVSLWLQLTRVNSQLAEENPWALSVHEGESVTVNCSYK<u>TSITALQ</u> WYRQKSGEGPAQLIL<u>IRSNERE</u>KRNGRLRATLDTSSQSSSLSITATRCEDTAV YFC<u>ATDFTTGGNYK</u>PTFGKGTSLVVHPDIQNPEPAVYQLKDPRSQDSTLCLFT DFDSQINVPKTMESGTFITDKTVLDMKAMDSKSNGAIAWSNQTSFTCQDIFKE TNATYPSSDVPCDATLTEKSFETDMNLNFQNLSVMGLRILLLLKVAGFNLLMTL RLWSSGSGATNFSLLKQAGDVEENPGPMATRLLCYTVLCLLGARILNSKVIQT PRYLVKGQGQKAKMRCIPE<u>KGHPVV</u>FWYQQNKNNEFKFLIN<u>FQNQEV</u>LQQIDM TEKRFSAECPSNSPCSLEIQSSEAGDSALYLC<u>ASSLGTGDYEQ</u>YFGPGTRLTV LEDLRNVTPPKVSLFEPSKAEIANKQKATLVCLARGFFPDHVELSWWVNGKEV HSGVSTDPQAYKESNYSYCLSSRLRVSATFWHNPRNHFRCQVPFHGLSEEDKW PEGSPKPVTQNISAEAWGRADCGITSASYQQGVLSATILYEILLGKATLYAVL VSTLVVMAMVKRKNS (SEQ ID NO: 24) | (SEQ ID NO: 195) |
| CT 557: pLenti 1 CEA TCR TRAV8-1*01 L110F 118P & 119T with murine constant region | MHSLLGLLMVSLWLQLTRVNSQLAEENPWALSVHEGESVTVNCSYK<u>TSITALQ</u> WYRQKSGEGPAQLIL<u>IRSNERE</u>KRNGRLRATLDTSSQSSSLSITATRCEDTAV YFC<u>ATDFTSGGNYK</u>PTFGKGTSLVVHPDIQNPEPAVYQLKDPRSQDSTLCLFT DFDSQINVPKTMESGTFITDKCVLDMKAMDSKSNGAIAWSNQTSFTCQDIFKE TNATYPSSDVPCDATLTEKSFETDMNLNFQNLLVIVLRILLLLKVAGFNLLMTL RLWSSGSGATNFSLLKQAGDVEENPGPMATRLLCYTVLCLLGARILNSKVIQT PRYLVKGQGQKAKMRCIPE<u>KGHPVV</u>FWYQQNKNNEFKFLIN<u>FQNQEV</u>LQQIDM TEKRFSAECPSNSPCSLEIQSSEAGDSALYLC<u>ASSLGLGDYEQ</u>YFGPGTRLTV LEDLRNVTPPKVSLFEPSKAEIANKQKATLVCLARGFFPDHVELSWWVNGKEV HSGVCTDPQAYKESNYSYCLSSRLRVSATFWHNPRNHFRCQVPFHGLSEEDKW PEGSPKPVTQNISAEAWGRADCGITSASYQQGVLSATILYEILLGKATLYAVL VSTLVVMAMVKRKNS (SEQ ID NO: 25) | (SEQ ID NO: 196) |
| CT 558: pLenti 1 CEA TCR TRAV8-1*01 S112T 118P & 119T with murine constant region | MHSLLGLLMVSLWLQLTRVNSQLAEENPWALSVHEGESVTVNCSYK<u>TSITALQ</u> WYRQKSGEGPAQLIL<u>IRSNERE</u>KRNGRLRATLDTSSQSSSLSITATRCEDTAV YFC<u>ATDLTTGGNYK</u>PTFGKGTSLVVHPDIQNPEPAVYQLKDPRSQDSTLCLFT DFDSQINVPKTMESGTFITDKCVLDMKAMDSKSNGAIAWSNQTSFTCQDIFKE TNATYPSSDVPCDATLTEKSFETDMNLNFQNLLVIVLRILLLLKVAGFNLLMTL RLWSSGSGATNFSLLKQAGDVEENPGPMATRLLCYTVLCLLGARILNSKVIQT PRYLVKGQGQKAKMRCIPE<u>KGHPVV</u>FWYQQNKNNEFKFLIN<u>FQNQEV</u>LQQIDM TEKRFSAECPSNSPCSLEIQSSEAGDSALYLC<u>ASSLGLGDYEQ</u>YFGPGTRLTV LEDLRNVTPPKVSLFEPSKAEIANKQKATLVCLARGFFPDHVELSWWVNGKEV HSGVCTDPQAYKESNYSYCLSSRLRVSATFWHNPRNHFRCQVPFHGLSEEDKW PEGSPKPVTQNISAEAWGRADCGITSASYQQGVLSATILYEILLGKATLYAVL VSTLVVMAMVKRKNS (SEQ ID NO: 26) | (SEQ ID NO: 197) |
| CT 559: pLenti 1 CEA TCR TRAV8-1*01 L110F S112T 119T with murine constant region | MHSLLGLLMVSLWLQLTRVNSQLAEENPWALSVHEGESVTVNCSYK<u>TSITALQ</u> WYRQKSGEGPAQLIL<u>IRSNERE</u>KRNGRLRATLDTSSQSSSLSITATRCEDTAV YFC<u>ATDFTTGGNYK</u>PTFGKGTSLVVHPDIQNPEPAVYQLKDPRSQDSTLCLFT DFDSQINVPKTMESGTFITDKCVLDMKAMDSKSNGAIAWSNQTSFTCQDIFKE TNATYPSSDVPCDATLTEKSFETDMNLNFQNLLVIVLRILLLLKVAGFNLLMTL RLWSSGSGATNFSLLKQAGDVEENPGPMATRLLCYTVLCLLGARILNSKVIQT PRYLVKGQGQKAKMRCIPE<u>KGHPVV</u>FWYQQNKNNEFKFLIN<u>FQNQEV</u>LQQIDM TEKRFSAECPSNSPCSLEIQSSEAGDSALYLC<u>ASSLGLGDYEQ</u>YFGPGTRLTV LEDLRNVTPPKVSLFEPSKAEIANKQKATLVCLARGFFPDHVELSWWVNGKEV HSGVCTDPQAYKESNYSYCLSSRLRVSATFWHNPRNHFRCQVPFHGLSEEDKW PEGSPKPVTQNISAEAWGRADCGITSASYQQGVLSATILYEILLGKATLYAVL VSTLVVMAMVKRKNS (SEQ ID NO: 27) | (SEQ ID NO: 198) |
| CT 560: pLenti 1 CEA TCR TRAV8-1*01 118P & 119T TRBV26*01 L117T with murine constant region | MHSLLGLLMVSLWLQLTRVNSQLAEENPWALSVHEGESVTVNCSYK<u>TSITALQ</u> WYRQKSGEGPAQLIL<u>IRSNERE</u>KRNGRLRATLDTSSQSSSLSITATRCEDTAV YFC<u>ATDLTSGGNYK</u>PTFGKGTSLVVHPDIQNPEPAVYQLKDPRSQDSTLCLFT DFDSQINVPKTMESGTFITDKCVLDMKAMDSKSNGAIAWSNQTSFTCQDIFKE TNATYPSSDVPCDATLTEKSFETDMNLNFQNLLVIVLRILLLLKVAGFNLLMTL RLWSSGSGATNFSLLKQAGDVEENPGPMATRLLCYTVLCLLGARILNSKVIQT PRYLVKGQGQKAKMRCIPE<u>KGHPVV</u>FWYQQNKNNEFKFLIN<u>FQNQEV</u>LQQIDM TEKRFSAECPSNSPCSLEIQSSEAGDSALYLC<u>ASSLGTGDYEQ</u>YFGPGTRLTV LEDLRNVTPPKVSLFEPSKAEIANKQKATLVCLARGFFPDHVELSWWVNGKEV HSGVCTDPQAYKESNYSYCLSSRLRVSATFWHNPRNHFRCQVPFHGLSEEDKW PEGSPKPVTQNISAEAWGRADCGITSASYQQGVLSATILYEILLGKATLYAVL VSTLVVMAMVKRKNS (SEQ ID NO: 28) | (SEQ ID NO: 199) |

TABLE 2-continued

MHC-I HLA-A*02 + CEA (IMIGVLVGV (SEQ ID NO: 2)) TCR sequences

| Construct | Amino Acid Sequence | DNA Sequence |
|---|---|---|
| CT 561: pLenti 1 CEA TCR TRAV8-1*01 L110F 118P & 119T TRBV26*01 L117T with murine constant region | MHSLLGLLMVSLWLQLTRVNSQLAEENPWALSVHEGESVTVNCSYK<u>TSITALQ</u> WYRQKSGEGPAQLIL<u>IRSNERE</u>KRNGRLRATLDTSSQSSSLSITATRCEDTAV YFC<u>ATDFTSGGNYK</u>PTFGKGTSLVVHPNIQNPEPAVYQLKDPRSQDSTLCLFT DFDSQINVPKTMESGTFITDKCVLDMKAMDSKSNGAIAWSNQTSFTCQDIFKE TNATYPSSDVPCDATLTEKSFETDMNLNFQNLLVIVLRILLLKVAGFNLLMTL RLWSSGSGATNFSLLKQAGDVEENPGPMATRLLCYTVLCLLGARILNSKVIQT PRYLVKGQGQKAKMRCIPE<u>KGHPV</u>VFWYQQNKNNEFKFLIN<u>FQNQEV</u>LQQIDM TEKRFSAECPSNSPCSLEIQSSEAGDSALYLC<u>ASSLGTGDYEQ</u>YFGPGTRLTV LEDLRNVTPPKVSLFEPSKAEIANKQKATLVCLARGFFPDHVELSWWVNGKEV HSGVCTDPQAYKESNYSYCLSSRLRVSATFWHNPRNHFRCQVQFHGLSEEDKW PEGSPKPVTQNISAEAWGRADCGITSASYQQGVLSATILYEILLGKATLYAVL VSTLVVMAMVKRKNS (SEQ ID NO: 29) | (SEQ ID NO: 200) |
| CT 562: pLenti 1 CEA TCR TRAV8-1*01 S112T 118P & 119T TRBV26*01 L117T with murine constant region | MHSLLGLLMVSLWLQLTRVNSQLAEENPWALSVHEGESVTVNCSYK<u>TSITALQ</u> WYRQKSGEGPAQLIL<u>IRSNERE</u>KRNGRLRATLDTSSQSSSLSITATRCEDTAV YFC<u>ATDLTTGGNYK</u>PTFGKGTSLVVHPNIQNPEPAVYQLKDPRSQDSTLCLFT DFDSQINVPKTMESGTFITDKCVLDMKAMDSKSNGAIAWSNQTSFTCQDIFKE TNATYPSSDVPCDATLTEKSFETDMNLNFQNLLVIVLRILLLKVAGFNLLMTL RLWSSGSGATNFSLLKQAGDVEENPGPMATRLLCYTVLCLLGARILNSKVIQT PRYLVKGQGQKAKMRCIPE<u>KGHPV</u>VFWYQQNKNNEFKFLIN<u>FQNQEV</u>LQQIDM TEKRFSAECPSNSPCSLEIQSSEAGDSALYLC<u>ASSLGTGDYEQ</u>YFGPGTRLTV LEDLRNVTPPKVSLFEPSKAEIANKQKATLVCLARGFFPDHVELSWWVNGKEV HSGVCTDPQAYKESNYSYCLSSRLRVSATFWHNPRNHFRCQVQFHGLSEEDKW PEGSPKPVTQNISAEAWGRADCGITSASYQQGVLSATILYEILLGKATLYAVL VSTLVVMAMVKRKNS (SEQ ID NO: 30) | (SEQ ID NO: 201) |
| CT 563: pLenti 1 CEA TCR TRAV8-1*01 L110F S112T 118P & 119T TRBV26*01 L117T with murine constant region | MHSLLGLLMVSLWLQLTRVNSQLAEENPWALSVHEGESVTVNCSYK<u>TSITALQ</u> WYRQKSGEGPAQLIL<u>IRSNERE</u>KRNGRLRATLDTSSQSSSLSITATRCEDTAV YFC<u>ATDFTTGGNYK</u>PTFGKGTSLVVHPNIQNPEPAVYQLKDPRSQDSTLCLFT DFDSQINVPKTMESGTFITDKCVLDMKAMDSKSNGAIAWSNQTSFTCQDIFKE TNATYPSSDVPCDATLTEKSFETDMNLNFQNLLVIVLRILLLKVAGFNLLMTL RLWSSGSGATNFSLLKQAGDVEENPGPMATRLLCYTVLCLLGARILNSKVIQT PRYLVKGQGQKAKMRCIPE<u>KGHPV</u>VFWYQQNKNNEFKFLIN<u>FQNQEV</u>LQQIDM TEKRFSAECPSNSPCSLEIQSSEAGDSALYLC<u>ASSLGTGDYEQ</u>YFGPGTRLTV LEDLRNVTPPKVSLFEPSKAEIANKQKATLVCLARGFFPDHVELSWWVNGKEV HSGVCTDPQAYKESNYSYCLSSRLRVSATFWHNPRNHFRCQVQFHGLSEEDKW PEGSPKPVTQNISAEAWGRADCGITSASYQQGVLSATILYEILLGKATLYAVL VSTLVVMAMVKRKNS (SEQ ID NO: 31) | (SEQ ID NO: 202) |
| CT 532: pLenti 1 CEA TCR TRAV8-1*01 TRBV26*01 with regular murine constant region | MHSLLGLLMVSLWLQLTRVNSQLAEENPWALSVHEGESVTVNCSYK<u>TSITALQ</u> WYRQKSGEGPAQLIL<u>IRSNERE</u>KRNGRLRATLDTSSQSSSLSITATRCEDTAV YFC<u>ATDLTSGGNYK</u>FGKGTSLVVHPDIQNPEPAVYQLKDPRSQDSTLCLFTDF DSQINVPKTMESGTFITDKTVLDMKAMDSKSNGAIAWSNQTSFTCQDIFKETN ATYPSSDVPCDATLTEKSFETDMNLNFQNLSVMGLRILLLKVAGFNLLMTLRL WSSGSGATNFSLLKQAGDVEENPGPMATRLLCYTVLCLLGARILNSKVIQTPR YLVKGQGQKAKMRCIPE<u>KGHPV</u>VFWYQQNKNNEFKFLIN<u>FQNQEV</u>LQQIDMTE KRFSAECPSNSPCSLEIQSSEAGDSALYLC<u>ASSLGLGDYEQ</u>YFGPGTRLTVLE DLRNVTPPKVSLFEPSKAEIANKQKATLVCLARGFFPDHVELSWWVNGKEVHS GVCTDPQAYKESNYSYCLSSRLRVSATFWHNPRNHFRCQVQFHGLSEEDKWPE GSPKPVTQNISAEAWGRADCGITSASYQQGVLSATILYEILLGKATLYAVLVS TLVVMAMVKRKNS (SEQ ID NO: 36) | (SEQ ID NO: 203) |
| CT 533; pLenti 1 CEA TCR TRAV8-1*01 TRBV26*01 L117T with regular murine constant region | MHSLLGLLMVSLWLQLTRVNSQLAEENPWALSVHEGESVTVNCSYK<u>TSITALQ</u> WYRQKSGEGPAQLIL<u>IRSNERE</u>KRNGRLRATLDTSSQSSSLSITATRCEDTAV YFC<u>ATDLTSGGNYK</u>FGKGTSLVVHPDIQNPEPAVYQLKDPRSQDSTLCLFTDF DSQINVPKTMESGTFITDKTVLDMKAMDSKSNGAIAWSNQTSFTCQDIFKETN ATYPSSDVPCDATLTEKSFETDMNLNFQNLSVMGLRILLLKVAGFNLLMTLRL WSSGSGATNFSLLKQAGDVEENPGPMATRLLCYTVLCLLGARILNSKVIQTPR YLVKGQGQKAKMRCIPE<u>KGHPV</u>VFWYQQNKNNEFKFLIN<u>FQNQEV</u>LQQIDMTE KRFSAECPSNSPCSLEIQSSEAGDSALYLC<u>ASSLGTGDYEQ</u>YFGPGTRLTVLE DLRNVTPPKVSLFEPSKAEIANKQKATLVCLARGFFPDHVELSWWVNGKEVHS GVCTDPQAYKESNYSYCLSSRLRVSATFWHNPRNHFRCQVQFHGLSEEDKWPE GSPKPVTQNISAEAWGRADCGITSASYQQGVLSATILYEILLGKATLYAVLVS TLVVMAMVKRKNS (SEQ ID NO: 37) | (SEQ ID NO: 204) |

TABLE 2-continued

MHC-I HLA-A*02 + CEA (IMIGVLVGV (SEQ ID NO: 2)) TCR sequences

| Construct | Amino Acid Sequence | DNA Sequence |
|---|---|---|
| CT 534: pLenti 1 CEA TCR TRAV8-1*01 TRBV26*01 murine constant region (no PT) | MHSLLGLLMVSLWLQLTRVNSQLAEENPWALSVHEGESVTVNCSYK<u>TSITALQ</u> WYRQKSGEGPAQLIL<u>IRSNERE</u>KRNGRLRATLDTSSQSSSLSITATRCEDTAV YFC<u>ATDLTSGGNYK</u>FGKGTSLVVHPNIQNPEPAVYQLKDPRSQDSTLCLFTDF DSQINVPKTMESGTFITDKTVLDMKAMDSKSNGAIAWSNQTSFTCQDIFKETN ATYPSSDVPCDATLTEKSFETDMNLNFQNLLVIVLRILLLKVAGFNLLMTRL WSSGSGATNFSLLKQAGDVEENPGPMATRLLCYTVLCLLGARILNSKVIQTPR YLVKGQGQKAKMRCIPE<u>KGHPV</u>VFWYQQNKNNEFKFLINF<u>QNQEV</u>LQQIDMTE KRFSAECPSNSPCSLEIQSSEAGDSALYLC<u>ASSLGLGDYEQ</u>YFGPGTRLTVLE DLRNVTPPKVSLFEPSKAEIANKQKATLVCLARGFFPDHVELSWWVNGKEVHS GVCTDPQAYKESNYSYCLSSRLRVSATFWHNPRNHFRCQVQFHGLSEEDKWPE GSPKPVTQNISAEAWGRADCGITSASYQQGVLSATILYEILLGKATLYAVLVS TLVVMAMVKRKNS (SEQ ID NO: 38) | (SEQ ID NO: 205) |
| CT 535: pLenti 1 CEA TCR TRAV8-1*01 L110F TRBV26*01 with regular murine constant region | MHSLLGLLMVSLWLQLTRVNSQLAEENPWALSVHEGESVTVNCSYK<u>TSITALQ</u> WYRQKSGEGPAQLIL<u>IRSNERE</u>KRNGRLRATLDTSSQSSSLSITATRCEDTAV YFC<u>ATDFTSGGNYK</u>FGKGTSLVVHPDIQNPEPAVYQLKDPRSQDSTLCLFTDF DSQINVPKTMESGTFITDKTVLDMKAMDSKSNGAIAWSNQTSFTCQDIFKETN ATYPSSDVPCDATLTEKSFETDMNLNFQNLLSVMGLRILLLKVAGFNLLMTRL WSSGSGATNFSLLKQAGDVEENPGPMATRLLCYTVLCLLGARILNSKVIQTPR YLVKGQGQKAKMRCIPE<u>KGHPV</u>VFWYQQNKNNEFKFLINF<u>QNQEV</u>LQQIDMTE KRFSAECPSNSPCSLEIQSSEAGDSALYLC<u>ASSLGLGDYEQ</u>YFGPGTRLTVLE DLRNVTPPKVSLFEPSKAEIANKQKATLVCLARGFFPDHVELSWWVNGKEVHS GVSTDPQAYKESNYSYCLSSRLRVSATFWHNPRNHFRCQVQFHGLSEEDKWPE GSPKPVTQNISAEAWGRADCGITSASYQQGVLSATILYEILLGKATLYAVLVS TLVVMAMVKRKNS (SEQ ID NO: 39) | (SEQ ID NO: 206) |
| CT 536: pLenti 1 CEA TCR TRAV8-1*01 L112T TRBV26*01 with regular murine constant region | MHSLLGLLMVSLWLQLTRVNSQLAEENPWALSVHEGESVTVNCSYK<u>TSITALQ</u> WYRQKSGEGPAQLIL<u>IRSNERE</u>KRNGRLRATLDTSSQSSSLSITATRCEDTAV YFC<u>ATDLTTGGNYK</u>FGKGTSLVVHPDIQNPEPAVYQLKDPRSQDSTLCLFTDF DSQINVPKTMESGTFITDKTVLDMKAMDSKSNGAIAWSNQTSFTCQDIFKETN ATYPSSDVPCDATLTEKSFETDMNLNFQNLSVMGLRILLLKVAGFNLLMTRL WSSGSGATNFSLLKQAGDVEENPGPMATRLLCYTVLCLLGARILNSKVIQTPR YLVKGQGQKAKMRCIPE<u>KGHPV</u>VFWYQQNKNNEFKFLINF<u>QNQEV</u>LQQIDMTE KRFSAECPSNSPCSLEIQSSEAGDSALYLC<u>ASSLGLGDYEQ</u>YFGPGTRLTVLE DLRNVTPPKVSLFEPSKAEIANKQKATLVCLARGFFPDHVELSWWVNGKEVHS GVSTDPQAYKESNYSYCLSSRLRVSATFWHNPRNHFRCQVQFHGLSEEDKWPE GSPKPVTQNISAEAWGRADCGITSASYQQGVLSATILYEILLGKATLYAVLVS TLVVMAMVKRKNS (SEQ ID NO: 40) | (SEQ ID NO: 207) |
| CT 537: pLenti 1 CEA TCR TRAV8-1*01 L110F & S112T TRBV26*01 with regular murine constant region | MHSLLGLLMVSLWLQLTRVNSQLAEENPWALSVHEGESVTVNCSYK<u>TSITALQ</u> WYRQKSGEGPAQLIL<u>IRSNERE</u>KRNGRLRATLDTSSQSSSLSITATRCEDTAV YFC<u>ATDFTTGGNYK</u>FGKGTSLVVHPDIQNPEPAVYQLKDPRSQDSTLCLFTDF DSQINVPKTMESGTFITDKTVLDMKAMDSKSNGAIAWSNQTSFTCQDIFKETN ATYPSSDVPCDATLTEKSFETDMNLNFQNLSVMGLRILLLKVAGFNLLMTRL WSSGSGATNFSLLKQAGDVEENPGPMATRLLCYTVLCLLGARILNSKVIQTPR YLVKGQGQKAKMRCIPE<u>KGHPV</u>VFWYQQNKNNEFKFLINF<u>QNQEV</u>LQQIDMTE KRFSAECPSNSPCSLEIQSSEAGDSALYLC<u>ASSLGLGDYEQ</u>YFGPGTRLTVLE DLRNVTPPKVSLFEPSKAEIANKQKATLVCLARGFFPDHVELSWWVNGKEVHS GVSTDPQAYKESNYSYCLSSRLRVSATFWHNPRNHFRCQVQFHGLSEEDKWPE GSPKPVTQNISAEAWGRADCGITSASYQQGVLSATILYEILLGKATLYAVLVS TLVVMAMVKRKNS (SEQ ID NO: 41) | (SEQ ID NO: 208) |
| CT 538: pLenti 1 CEA TCR TRAV8-1*01 L110F TRBV26*01 L117T with regular murine constant region | MHSLLGLLMVSLWLQLTRVNSQLAEENPWALSVHEGESVTVNCSYK<u>TSITALQ</u> WYRQKSGEGPAQLIL<u>IRSNERE</u>KRNGRLRATLDTSSQSSSLSITATRCEDTAV YFC<u>ATDFTSGGNYK</u>FGKGTSLVVHPDIQNPEPAVYQLKDPRSQDSTLCLFTDF DSQINVPKTMESGTFITDKTVLDMKAMDSKSNGAIAWSNQTSFTCQDIFKETN ATYPSSDVPCDATLTEKSFETDMNLNFQNLSVMGLRILLLKVAGFNLLMTRL WSSGSGATNFSLLKQAGDVEENPGPMATRLLCYTVLCLLGARILNSKVIQTPR YLVKGQGQKAKMRCIPE<u>KGHPV</u>VFWYQQNKNNEFKFLINF<u>QNQEV</u>LQQIDMTE KRFSAECPSNSPCSLEIQSSEAGDSALYLC<u>ASSLGTGDYEQ</u>YFGPGTRLTVLE DLRNVTPPKVSLFEPSKAEIANKQKATLVCLARGFFPDHVELSWWVNGKEVHS GVSTDPQAYKESNYSYCLSSRLRVSATFWHNPRNHFRCQVQFHGLSEEDKWPE GSPKPVTQNISAEAWGRADCGITSASYQQGVLSATILYEILLGKATLYAVLVS TLVVMAMVKRKNS (SEQ ID NO: 42) | (SEQ ID NO: 209) |

TABLE 2-continued

MHC-I HLA-A*02 + CEA (IMIGVLVGV (SEQ ID NO: 2)) TCR sequences

| Construct | Amino Acid Sequence | DNA Sequence |
|---|---|---|
| CT 539: pLenti 1 CEA TCR TRAV8-1*01 S112T TRBV26*01 L117T with regular murine constant region | MHSLLGLLMVSLWLQLTRVNSQLAEENPWALSVHEGESVTVNCSYK<u>TSITALQ</u> WYRQKSGEGPAQLIL<u>IRSNERE</u>KRNGRLRATLDTSSQSSSLSITATRCEDTAV YFC<u>ATDLTTGGNYK</u>FGKGTSLVVHPDIQNPEPAVYQLKDPRSQDSTLCLFTDF DSQINVPKTMESGTFITDKTVLDMKAMDSKSNGAIAWSNQTSFTCQDIFKETN ATYPSSDVPCDATLTEKSFETDMNLNFQNLSVMGLRILLLKVAGFNLLMTLRL WSSGSGATNFSLLKQAGDVEENPGPMATRLLCYTVLCLLGARILNSKVIQTPR YLVKGQGQKAKMRCIP<u>EKGHPV</u>VFWYQQNKNNEFKFLIN<u>FQNQEV</u>LQQIDMTE KRFSAECPSNSPCSLEIQSSEAGDSALYLC<u>ASSLGTGDYEQ</u>YFGPGTRLTVLE DLRNVTPPKVSLFEPSKAEIANKQKATLVCLARGFFPDHVELSWWVNGKEVHS GVSTDPQAYKESNYSYCLSSRLRVSATFWHNPRNHFRCQVQFHGLSEEDKWPE GSPKPVTQNISAEAWGRADCGITSASYQQGVLSATILYEILLGKATLYAVLVS TLVVMAMVKRKNS (SEQ ID NO: 43) | (SEQ ID NO: 210) |
| CT 540: pLenti 1 CEA TCR TRAV8-1*01 L110F & S112T TRBV26*01 L117T with regular murine constant region | MHSLLGLLMVSLWLQLTRVNSQLAEENPWALSVHEGESVTVNCSYK<u>TSITALQ</u> WYRQKSGEGPAQLIL<u>IRSNERE</u>KRNGRLRATLDTSSQSSSLSITATRCEDTAV YFC<u>ATDFTTGGNYK</u>FGKGTSLVVHPDIQNPEPAVYQLKDPRSQDSTLCLFTDF DSQINVPKTMESGTFITDKTVLDMKAMDSKSNGAIAWSNQTSFTCQDIFKETN ATYPSSDVPCDATLTEKSFETDMNLNFQNLSVMGLRILLLKVAGFNLLMTLRL WSSGSGATNFSLLKQAGDVEENPGPMATRLLCYTVLCLLGARILNSKVIQTPR YLVKGQGQKAKMRCIP<u>EKGHPV</u>VFWYQQNKNNEFKFLIN<u>FQNQEV</u>LQQIDMTE KRFSAECPSNSPCSLEIQSSEAGDSALYLC<u>ASSLGTGDYEQ</u>YFGPGTRLTVLE DLRNVTPPKVSLFEPSKAEIANKQKATLVCLARGFFPDHVELSWWVNGKEVHS GVSTDPQAYKESNYSYCLSSRLRVSATFWHNPRNHFRCQVQFHGLSEEDKWPE GSPKPVTQNISAEAWGRADCGITSASYQQGVLSATILYEILLGKATLYAVLVS TLVVMAMVKRKNS (SEQ ID NO: 44) | (SEQ ID NO: 211) |
| CT 541: pLenti 1 CEA TCR TRAV8-1*01 L110F TRBV26*01 with murine constant region | MHSLLGLLMVSLWLQLTRVNSQLAEENPWALSVHEGESVTVNCSYK<u>TSITALQ</u> WYRQKSGEGPAQLIL<u>IRSNERE</u>KRNGRLRATLDTSSQSSSLSITATRCEDTAV YFC<u>ATDFTSGGNYK</u>FGKGTSLVVHPNIQNPEPAVYQLKDPRSQDSTLCLFTDF DSQINVPKTMESGTFITDKCVLDMKAMDSKSNGAIAWSNQTSFTCQDIFKETN ATYPSSDVPCDATLTEKSFETDMNLNFQNLLVIVLRILLLKVAGFNLLMTLRL WSSGSGATNFSLLKQAGDVEENPGPMATRLLCYTVLCLLGARILNSKVIQTPR YLVKGQGQKAKMRCIP<u>EKGHPV</u>VFWYQQNKNNEFKFLIN<u>FQNQEV</u>LQQIDMTE KRFSAECPSNSPCSLEIQSSEAGDSALYLC<u>ASSLGLGDYEQ</u>YFGPGTRLTVLE DLRNVTPPKVSLFEPSKAEIANKQKATLVCLARGFFPDHVELSWWVNGKEVHS GVCTDPQAYKESNYSYCLSSRLRVSATFWHNPRNHFRCQVQFHGLSEEDKWPE GSPKPVTQNISAEAWGRADCGITSASYQQGVLSATILYEILLGKATLYAVLVS TLVVMAMVKRKNS (SEQ ID NO: 45) | (SEQ ID NO: 212) |
| CT 542: pLenti 1 CEA TCR TRAV8-1*01 S112T TRBV26*01 with murine constant region | MHSLLGLLMVSLWLQLTRVNSQLAEENPWALSVHEGESVTVNCSYK<u>TSITALQ</u> WYRQKSGEGPAQLIL<u>IRSNERE</u>KRNGRLRATLDTSSQSSSLSITATRCEDTAV YFC<u>ATDLTTGGNYK</u>FGKGTSLVVHPNIQNPEPAVYQLKDPRSQDSTLCLFTDF DSQINVPKTMESGTFITDKCVLDMKAMDSKSNGAIAWSNQTSFTCQDIFKETN ATYPSSDVPCDATLTEKSFETDMNLNFQNLLVIVLRILLLKVAGFNLLMTLRL WSSGSGATNFSLLKQAGDVEENPGPMATRLLCYTVLCLLGARILNSKVIQTPR YLVKGQGQKAKMRCIP<u>EKGHPV</u>VFWYQQNKNNEFKFLIN<u>FQNQEV</u>LQQIDMTE KRFSAECPSNSPCSLEIQSSEAGDSALYLC<u>ASSLGLGDYEQ</u>YFGPGTRLTVLE DLRNVTPPKVSLFEPSKAEIANKQKATLVCLARGFFPDHVELSWWVNGKEVHS GVCTDPQAYKESNYSYCLSSRLRVSATFWHNPRNHFRCQVQFHGLSEEDKWPE GSPKPVTQNISAEAWGRADCGITSASYQQGVLSATILYEILLGKATLYAVLVS TLVVMAMVKRKNS (ESQ ID NO: 46) | (SEQ ID NO: 213) |
| CT 543: pLenti 1 CEA TCR TRAV8-1*01 L110F & S112T TRBV26*01 with murine constant region | MHSLLGLLMVSLWLQLTRVNSQLAEENPWALSVHEGESVTVNCSYK<u>TSITALQ</u> WYRQKSGEGPAQLIL<u>IRSNERE</u>KRNGRLRATLDTSSQSSSLSITATRCEDTAV YFC<u>ATDFTTGGNYK</u>FGKGTSLVVHPNIQNPEPAVYQLKDPRSQDSTLCLFTDF DSQINVPKTMESGTFITDKCVLDMKAMDSKSNGAIAWSNQTSFTCQDIFKETN ATYPSSDVPCDATLTEKSFETDMNLNFQNLLVIVLRILLLKVAGFNLLMTLRL WSSGSGAGNFSLLKQAGDVEENPGPMATRLLCYTVLCLLGARILNSKVIQTPR YLVKGQGQKAKMRCIP<u>EKGHPV</u>VFWYQQNKNNEFKFLIN<u>FQNQEV</u>LQQIDMTE KRFSAECPSNSPCSLEIQSSEAGDSALYLC<u>ASSLGLGDYEQ</u>YFGPGTRLTVLE DLRNVTPPKVSLFEPSKAEIANKQKATLVCLARGFFPDHVELSWWVNGKEVHS GVCTDPQAYKESNYSYCLSSRLRVSATFWHNPRNHFRCQVQFHGLSEEDKWPE GSPKPVTQNISAEAWGRADCGITSASYQQGVLSATILYEILLGKATLYAVLVS TLVVMAMVKRKNS (SEQ ID NO: 47) | (SEQ ID NO: 214) |

TABLE 2-continued

MHC-I HLA-A*02 + CEA (IMIGVLVGV (SEQ ID NO: 2)) TCR sequences

| Construct | Amino Acid Sequence | DNA Sequence |
|---|---|---|
| CT 544: pLenti 1 CEA TCR TRAV8-1*01 TBV26*01 L117T with murine constant region | MHSLLGLLMVSLWLQLTRVNSQLAEENPWALSVHEGESVTVNCSYK<u>TSITALQ</u> WYRQKSGEGPAQLIL<u>IRSNERE</u>KRNGRLRATLDTSSQSSSLSITATRCEDTAV YFC<u>ATDLTSGGNYK</u>FGKGTSLVVHPNIQNPEPAVYQLKDPRSQDSTLCLFTDF DSQINVPKTMESGTFITDKCVLDMKAMDSKSNGAIAWSNQTSFTCQDIFKETN ATYPSSDVPCDATLTEKSFETDMNLNFQNLLVIVLRILLLKVAGFNLLMTLRL WSSGSGATNFSLLKQAGDVEENPGPMATRLLCYTVLCLLGARILNSKVIQTPR YLVKGQGQKAKMRCIPE<u>KGHPV</u>VFWYQQNKNNEFKFLIN<u>FQNQEV</u>LQQIDMTE KRFSAECPSNSPCSLEIQSSEAGDSALYLC<u>ASSLGTGDYE</u>QYFGPGTRLTVLE DLRNVTPPKVSLFEPSKAEIANKQKATLVCLARGFFPDHVELSWWVNGKEVHS GVCTDPQAYKESNYSYCLSSRLRVSATFWHNPRNHFRCQVQFHGLSEEDKWPE GSPKPVTQNISAEAWGRADCGITSASYQQGVLSATILYEILLGKATLYAVLVS TLVVMAMVKRKNS (SEQ ID NO: 48) | (SEQ ID NO: 215) |
| CT 545: pLenti 1 CEA TCR TRAV8-1*01 L110F TRBV26*01 L117T with murine constant region | MHSLLGLLMVSLWLQLTRVNSQLAEENPWALSVHEGESVTVNCSYK<u>TSITALQ</u> WYRQKSGEGPAQLIL<u>IRSNERE</u>KRNGRLRATLDTSSQSSSLSITATRCEDTAV YFC<u>ATDLTSGGNYK</u>FGKGTSLVVHPNIQNPEPAVYQLKDPRSQDSTLCLFTDF DSQINVPKTMESGTFITDKCVLDMKAMDSKSNGAIAWSNQTSFTCQDIFKETN ATYPSSDVPCDATLTEKSFETDMNLNFQNLLVIVLRILLLKVAGFNLLMTLRL WSSGSGATNFSLLKQAGDVEENPGPMATRLLCYTVLCLLGARILNSKVIQTPR YLVKGQGQKAKMRCIPE<u>KGHPV</u>VFWYQQNKNNEFKFLIN<u>FQNQEV</u>LQQIDMTE KRFSAECPSNSPCSLEIQSSEAGDSALYLC<u>ASSLGTGDYE</u>QYFGPGTRLTVLE DLRNVTPPKVSLFEPSKAEIANKQKATLVCLARGFFPDHVELSWWVNGKEVHS GVCTDPQAYKESNYSYCLSSRLRVSATFWHNPRNHFRCQVQFHGLSEEDKWPE GSPKPVTQNISAEAWGRADCGITSASYQQGVLSATILYEILLGKATLYAVLVS TLVVMAMVKRKNS (SEQ ID NO: 49) | (SEQ ID NO: 216) |
| CT 546: pLenti 1 CEA TCR TRAV8-1*01 S112T TRBV26*01 L117T with murine constant region | MHSLLGLLMVSLWLQLTRVNSQLAEENPWALSVHEGESVTVNCSYK<u>TSITALQ</u> WYRQKSGEGPAQLIL<u>IRSNERE</u>KRNGRLRATLDTSSQSSSLSITATRCEDTAV YFC<u>ATDLTTGGNYK</u>FGKGTSLVVHPNIQNPEPAVYQLKDPRSQDSTLCLFTDF DSQINVPKTMESGTFITDKCVLDMKAMDSKSNGAIAWSNQTSFTCQDIFKETN ATYPSSDVPCDATLTEKSFETDMNLNFQNLLVIVLRILLLKVAGFNLLMTLRL WSSGSGATNFSLLKQAGDVEENPGPMATRLLCYTVLCLLGARILNSKVIQTPR YLVKGQGQKAKMRCIPE<u>KGHPV</u>VFWYQQNKNNEFKFLIN<u>FQNQEV</u>LQQIDMTE KRFSAECPSNSPCSLEIQSSEAGDSALYLC<u>ASSLGTGDYE</u>QYFGPGTRLTVLE DLRNVTPPKVSLFEPSKAEIANKQKATLVCLARGFFPDHVELSWWVNGKEVHS GVCTDPQAYKESNYSYCLSSRLRVSATFWHNPRNHFRCQVQFHGLSEEDKWPE GSPKPVTQNISAEAWGRADCGITSASYQQGVLSATILYEILLGKATLYAVLVS TLVVMAMVKRKNS (SEQ ID NO: 50) | (SEQ ID NO: 217) |
| CT 547: pLenti 1 CEA TCR TRAV8-1*01 L110F & S112T TRBV26*01 L117T with murine constant region | MHSLLGLLMVSLWLQLTRVNSQLAEENPWALSVHEGESVTVNCSYK<u>TSITALQ</u> WYRQKSGEGPAQLIL<u>IRSNERE</u>KRNGRLRATLDTSSQSSSLSITATRCEDTAV YFC<u>ATDFTTGGNYK</u>FGKGTSLVVHPNIQNPEPAVYQLKDPRSQDSTLCLFTDF DSQINVPKTMESGTFITDKCVLDMKAMDSKSNGAIAWSNQTSFTCQDIFKETN ATYPSSDVPCDATLTEKSFETDMNLNFQNLLVIVLRILLLKVAGFNLLMTLRL WSSGSGATNFSLLKQAGDVEENPGPMATRLLCYTVLCLLGARILNSKVIQTPR YLVKGQGQKAKMRCIPE<u>KGHPV</u>VFWYQQNKNNEFKFLIN<u>FQNQEV</u>LQQIDMTE KRFSAECPSNSPCSLEIQSSEAGDSALYLC<u>ASSLGTGDYE</u>QYFGPGTRLTVLE DLRNVTPPKVSLFEPSKAEIANKQKATLVCLARGFFPDHVELSWWVNGKEVHS GVCTDPQAYKESNYSYCLSSRLRVSATFWHNPRNHFRCQVQFHGLSEEDKWPE GSPKPVTQNISAEAWGRADCGITSASYQQGVLSATILYEILLGKATLYAVLVS TLVVMAMVKRKNS (SEQ ID NO: 51) | (SEQ ID NO: 218) |

In some embodiments, the first receptor comprises a sequence at least 80% identical, at least 85% identical, at least 90% identical, at least 95% identical, at least 96% identical, at least 97% identical, at least 98% identical, at least 99% identical, or at least 99.5% identical to a sequence or subsequence of any one of SEQ ID NOS: 16-31 or 36-51. In some embodiments, the first receptor comprises a sequence or subsequence of any one of SEQ ID NOS: 16-31 or 36-51.

In some embodiments, the first receptor comprises a TCR alpha chain comprising or consisting essentially of amino acids 1-270 of any one of SEQ ID NOS: 16-31, or a sequence that is at least 80% identical, at least 85% identical, at least 90% identical, at least 95% identical, at least 96% identical, at least 97% identical, at least 98% identical, at least 99% identical, or at least 99.5% identical thereto. In some embodiments, the first receptor comprises a TCR alpha chain comprising or consisting essentially of amino acids 1-270 of any one of SEQ ID NOS: 16-31.

In some embodiments, the first receptor comprises a TCR beta chain comprising or consisting essentially of amino acids 293-598 of any one of SEQ ID NOS: 16-31, or a sequence that is at least 80% identical, at least 85% identical, at least 90% identical, at least 95% identical, at least 96% identical, at least 97% identical, at least 98% identical, at least 99% identical, or at least 99.5% identical thereto. In some embodiments, the first receptor comprises a TCR beta chain comprising or consisting essentially of amino acids 293-598 of any one of SEQ ID NOS: 16-31.

In some embodiments, the first receptor comprises a TCR alpha chain comprising amino acids 1-270 of any one of SEQ ID NOS: 16-31, and a TCR beta chain comprising amino acids 293-598 of any one of SEQ ID NOS: 16-31.

In some embodiments, the first receptor comprises a TCR alpha chain comprising or consisting essentially of amino acids 1-268 of any one of SEQ ID NOS: 36-51, or a sequence that is at least 80% identical, at least 85% identical, at least 90% identical, at least 95% identical, at least 96% identical, at least 97% identical, at least 98% identical, at least 99% identical, or at least 99.5% identical thereto. In some embodiments, the first receptor comprises a TCR alpha chain comprising or consisting essentially of amino acids 1-268 of any one of SEQ ID NOS: 36-51.

In some embodiments, the first receptor comprises a TCR beta chain comprising or consisting essentially of amino acids 291-596 of any one of SEQ ID NOS: 36-51, or a sequence that is at least 80% identical, at least 85% identical, at least 90% identical, at least 95% identical, at least 96% identical, at least 97% identical, at least 98% identical, at least 99% identical, or at least 99.5% identical thereto. In some embodiments, the first receptor comprises a TCR beta chain comprising or consisting essentially of amino acids 291-596 of any one of SEQ ID NOS: 36-51.

In some embodiments, the first receptor comprises a TCR alpha chain comprising amino acids 1-268 of any one of SEQ ID NOS: 36-51, and a TCR beta chain comprising amino acids 291-596 of any one of SEQ ID NOS: 36-51.

In some embodiments, the extracellular ligand binding domain of the first receptor is an scFv. In some embodiments, the scFv domain binds to CEA. In some embodiments, the scFv is the ligand binding domain of a CAR. Exemplary CAR sequences comprising CEA targeting scFv domains are shown in Table 3 below. In Table 3, CDR sequences are underlined.

TABLE 3

Exemplary CARs with scFv that target CEA

| Protein Sequence | Nucleotide Sequence |
|---|---|
| MDMRVPAQLLGLLLLWLRG ARCQVQLVQSGSELKKPGA SVKVSCKASGYTFT<u>EFGMN</u> WVRQAPGQGLEWMG<u>WINTK TGEATYVEEFKGR</u>FVFSLD TSVSTAYLQISSLKAEDTA VYYCAR<u>WDFAYYVEAMDY</u>W GQGTTVTVSSGGGGSGGGG SGGGGSGGDIQMTQSPSSL SASVGDRVTITC<u>KASQNVG TNVA</u>WYQQKPGKAPKLLIY <u>SASYRYS</u>GVPSRFSGSGSG TDFTLTISSLQPEDFATYY C<u>HQYYTYPLFT</u>FGQGTKLE IKTTTTPAPRPPTPAPTIAS QPLSLRPEACRPAAGGAVH TRGLDFACDFWVLVVVGGV LACYSLLVTVAFIIFWVRS KRSRLLHSDYMNMTPRRPG PTRKHYQPYAPPRDFAAYR SKRGRKKLLYIFKQPFMRP VQTTQEEDGCSCRFPEEEE GGCELRVKFSRSADAPAYK QGQNQLYNELNLGRREEYD VLDKRRGRDPEMGGKPRRK NPQEGLYNELQKDKMAEAY SEIGMKGERRRGKGHDGLY QGLSTATKDTYDALHMQAL PPR (SEQ ID NO: 52) | ATGGACATGAGGGTCCCCGCTCAGCTCCTGGGGCTCCTGCTACTCTGGCTC CGAGGTGCCAGATGTCAGGTGCAGCTGGTGCAATCTGGGTCTGAGTTGAAG AAGCCTGGGGCCTCAGTGAAGGTTTCCTGCAAGGCTTCTGGATACACCTTC ACTGAGTTTGGAATGAACTGGGTGCGACAGGCCCCTGGACAAGGGCTTGAG TGGATGGGATGGATAAACACCAAAACTGGAGAGGCAACATATGTTGAAGAG TTTAAGGGACGGTTTGTCTTCTCCTTGGACACCTCTGTCAGCACGGCATAT CTGCAGATCAGCAGCCTAAAGGCTGAAGACACTGCCGTGTATTACTGTGCG AGATGGGACTTCGCTTATTACGTGGAGGCTATGGACTACTGGGGCCAAGGG ACCACGGTGACCGTGTCATCCGGCGGAGGTGGAAGCGGAGGGGGAGGATCT GGCGGCGGAGGAAGCGGAGGCGATATCCAGATGACCCAGTCTCCATCCTCC CTGTCTGCATCTGTGGGAGACAGAGTCACCATCACTTGCAAGGCCAGTCAG AATGTGGGTACTAATGTTGCCTGGTATCAGCAGAAACCAGGGAAAGCACCT AAGCTCCTGATCTATTCGGCATCCTACCGCTACAGTGGAGTCCCATCAAGG TTCAGTGGCAGTGGATCTGGGACAGATTTCACTCTCACCATCAGCAGTCTG CAACCTGAAGATTTCGCAACTTACTACTGTCACCAATATTACACCTATCCT CTATTCACGTTTGGCCAGGGCACCAAGCTCGAGATCAAGACAACGACGCCA GCTCCCCGCCCGCCAACCCCTGCACCTACGATTGCATCACAACCGCTGTCC TGCGGCCTGAAGCTTGTCGCCCAGCCGCAGGTGGCGCCGTACATACACGGG GGCTGGATTTTGCCTGTGATTTCTGGGTGCTGGTCGTTGTGGGCGGCGTGC TGGCCTGCTACAGCCTGCTGGTGACAGTGGCCTTCATCATCTTTTGGGTGA GGAGCAAGCGGAGTCGACTGCTGCACAGCGACTACATGAACATGACCCCCC GGAGGCCTGGCCCCACCCGGAAGCACTACCAGCCCTACGCCCCTCCCAGGG ATTTCGCCGCCTACCGGAGCAAACGGGGCAGAAAGAAACTCCTGTATATAT TCAAACAACCATTTATGAGGCCAGTACAAACTACTCAAGAGGAAGATGGCT GTAGCTGCCGATTTCCAGAAGAAGAAGAGGAGGATGTGAACTGAGAGTGA AGTTCAGCAGGAGCGCAGACGCCCCCGCGTACAAGCAGGGCCAGAACCAGC TCTATAACGAGCTCAATCTAGGACGAAGAGAGGAGTACGATGTTTTGGACA AGCGTAGAGGCCGGGACCCTGAGATGGGGGGAAAGCCGAGAAGGAAGAACC CTCAGGAAGGCCTGTACAATGAACTGCAGAAAGATAAGATGGCGGAGGCCT ACAGTGAGATTGGGATGAAAGGCGAGCGCCGGAGGGGCAAGGGGCACGATG GCCTTTACCAGGGACTCAGTACAGCCACCAAGGACACCTACGACGCCCTTC ACATGCAGGCCCTGCCCCCTCGCTAA (SEQ ID NO: 219) |
| MDMRVPAQLLGLLLLWLRG ARCQVQLVQSGAEVKKPGA SVKSCKASGYTFT<u>EFGMN</u>W VRQAPGQGLEWMG<u>WINTKT GEATYVEEFKGR</u>VTFTTDT STSTAYMELRSLRSDDTAV YYCAR<u>WDFAYYVEAMDY</u>WG QGTTVTVSSGGGGSGGGGS GGGGSGGDIQMTQSPSSLS ASVGDRVTITC<u>KASAAVGT YVA</u>WYQQKPGKAPKLLIY<u>S ASYRKR</u>GVPSRFSGSGSGT DFTLTISSLQPEDFATYYC <u>HQYYTYPLFT</u>FGQGTKLEI KRTTTTPAPRPPTPAPTIA SQPLSLRPEACRPAAGGAV | ATGGACATGAGGGTCCCCGCTCAGCTCCTGGGGCTCCTGCTACTCTGGCTC CGAGGTGCCAGATGTCAGGTGCAGCTGGTGCAGTCTGGCGCCGAAGTGAAG AAACCTGGAGCTAGTGTGAAGGTGTCCTGCAAGGCCAGCGGCTACACCTTC ACCGAGTTCGGCATGAACTGGGTCCGACAGGCTCCAGGCCAGGGCCTCGAA TGGATGGGCTGGATCAACACCAAGACCGGCGAGGCCACCTACGTGGAAGAG TTCAAGGGCAGAGTGACTTCACCACGGACACCAGCACCAGCACCGCCTACA TGGAACTGCGGAGCCTGAGAAGCGACGACACCGCCGTGTACTACTGCGCCA GATGGGACTTCGCTTATTACGTGGAAGCCATGGACTACTGGGGCCAGGGCA CCACCGTGACCGTGTCTAGCGGCGGAGGTGGAAGCGGAGGGGGAGGATCTG GCGGCGGAGGAAGCGGAGGCGATATCCAGATGACCCAGTCTCCATCCTCCC TGTCTGCATCTGTGGGAGACAGAGTCACCATCACTTGCAAGGCCAGTGCGG CTGTGGGTACGTATGTTGCGTGGTATCAGCAGAAACCAGGGAAAGCACCTA AGCTCCTGATCTATTCGGCATCCTACCGCAAAAGGGGAGTCCCATCAAGGT TCAGTGGCAGTGGATCTGGGACAGATTTCACTCTCACCATCAGCAGTCTGC AACCTGAAGATTTCGCAACTTACTACTGTCACCAATATTACACCTATCCTC TATTCACGTTTGGCCAGGGCACCAAGCTCGAGATCAAGCGTACGACAACGA |

TABLE 3-continued

Exemplary CARs with scFv that target CEA

| Protein Sequence | Nucleotide Sequence |
|---|---|
| HTRGLDFACDFWVLVVGG VLACYSLLVTVAFIIFWVR SKRSRLLHSDYMNMTPRRP GPTRKHYQPYAPPRDFAAY RSKRGRKKLLYIFKQPFMR PVQTTQEEDGCSCRFPEEE EGGCELRVKFSRSADAPAY KQGQNQLYNELNLGRREEY DVLDKRRGRDPEMGGKPRR KNPQEGLYNELQKDKMAEA YSEIGMKGERRRGKGHDGL YQGLSTATKDTYDALHMQA LPPR (SEQ ID NO: 53) | CGCCAGCTCCCCGCCCGCCAACCCCTGCACCTACGATTGCATCACAACCGC TGTCCTGCGGCCTGAAGCTTGTCGCCCAGCCGCAGGTGGCGCCGTACATAC ACGGGGGCTGGATTTTGCCTGTGATTTCTGGGTGCTGGTCGTTGTGGGCGG CGTGCTGGCCTGCTACAGCCTGCTGGTGACAGTGGCCTTCATCATCTTTTG GGTGAGGAGCAAGCGGAGTCGACTGCTGCACAGCGACTACATGAACATGAC CCCCCGGAGGCCTGGCCCCACCCGGAAGCACTACCAGCCCTACGCCCCTCC CAGGGATTTCGCCGCCTACCGGAGCAAACGGGGCAGAAAGAAACTCCTGTA TATATTCAAACAACCATTTATGAGGCCAGTACAAACTACTCAAGAGGAAGA TGGCTGTAGCTGCCGATTTCCAGAAGAAGAAGAAGGAGGATGTGAACTGAG AGTGAAGTTCAGCAGGAGCGCAGACGCCCCCGCGTACAAGCAGGGCCAGAA CCAGCTCTATAACGAGCTCAATCTAGGACAAGAGAGGAGTACGATGTTTT GGACAAGCGTAGAGGCCGGGACCCTGAGATGGGGGGAAAGCCGAGAAGGAA GAACCCTCAGGAAGGCCTGTACAATGAACTGCAGAAAGATAAGATGGCGGA GGCCTACAGTGAGATTGGGATGAAAGGCGAGCGCCGGAGGGGCAAGGGGCA CGATGGCCTTTACCAGGGACTCAGTACAGCCACCAAGGACACCTACGACGC CCTTCACATGCAGGCCCTGCCCCCTCGCTAG (SEQ ID NO: 220) |
| MDMRVPAQLLGLLLLWLRG ARCQVQLVQSGSELKKPGA SVKVSCKASGYTFT<u>EFGMN</u> WVRQAPGQGLEWMG<u>WINTK TGEATYVEEFKG</u>RFVFSLD TSVSTAYLQISSLKAEDTA VYYCAR<u>WDFAHYFQTMDY</u>W GQGTTVTVSSGGGGSGGGG SGGGGSGGDIQMTQSPSSL SASVGDRVTITC<u>KASAAVG TYVAWYQQKPGKAPKLLIY SASYRKR</u>GVPSRFSGSGSG TDFTLTISSLQPEDFATYY C<u>HQYYTYPLFT</u>FGQGTKLE IKRTTTPAPRPPTPAPTIA SQPLSLRPEACRPAAGGAV HTRGLDFACDFWVLVVGG VLACYSLLVTVAFIIFWVR SKRSRLLHSDYMNMTPRRP GPTRKHYQPYAPPRDFAAY RSKRGRKKLLYIFKQPFMR PVQTTQEEDGCSCRFPEEE EGGCELRVKFSRSADAPAY KQGQNQLYNELNLGRREEY DVLDKRRGRDPEMGGKPRR KNPQEGLYNELQKDKMAEA YSEIGMKGERRRGKGHDGL YQGLSTATKDTYDALHMQA LPPR (SEQ ID NO: 54) | ATGGACATGAGGGTCCCCGCTCAGCTCCTGGGGCTCCTGCTACTCTGGCTC CGAGGTGCCAGATGTCAGGTGCAGCTGGTGCAATCTGGGTCTGAGTTGAAG AAGCCTGGGGCCTCAGTGAAGGTTTCCTGCAAGGCTTCTGGATACACCTTC ACTGAGTTTGAATGAACTGGGTGCGACAGGCCCCTGGACAAGGGCTTGAG TGGATGGGATGGATAAACACCAAAACTGGAGAGGCAACATATGTTGAAGAG TTTAAGGGACGGTTTGTCTTCTCCTTGGACACCTCTGTCAGCACGGCATAT CTGCAGATCAGCAGCCTAAAGGCTGAAGACACTGCCGTGTATTACTGTGCG AGATGGGACTTTGCTCATTACTTTCAGACTATGGACTACTGGGGGCCAAGGG ACCACGGTCACCGTCTCCTCAGGCGGAGGTGGAAGCGGAGGGGGAGGATCT GGCGGCGGAGGAAGCGGAGGCGATATCCAGATGACCCAGTCTCCATCCTCC CTGTCTGCATCTGTGGGAGACAGAGTCACCATCACTTGCAAGGCCAGTGCG GCTGTGGGTACGTATGTTGCAGTGGTATCAGCAGAAACCAGGGAAAGCACCT AAGCCTCTGATCTATTCGGCATCCTACCGCAAAAGGGGAGGTCCCATCAAGG TTCAGTGGCAGTGGATCTGGACAGATTTCACTCTCACCATCAGCAGTCTG CAACCTGAAGATTTCGCAACTTACTACTGTCACCAATATTACACCTATCCT CTATTCACGTTTGGCCAGGGCACCAAGCTCGAGATCAAGCGTACAACGACG CCAGCTCCCCGCCCGCCAACCCCTGCACCTACGATTGCATCACAACCGCTG TCCCTGCGGCCTGAAGCTTGTCGCCCAGCCGCAGGTGGCGCCGTACATACA CGGGGGCTGGATTTTGCCTGTGATTTCTGGGTGCTGGTCGTTGTGGGCGGC GTGCTGGCCTGCTACAGCCTGCTGGTGACAGTGGCCTTCATCATCTTTTGG GTGAGGAGCAAGCGGAGTCGACTGCTGCACAGCGACTACATGAACATGACC CCCCGGAGGCCTGGCCCCACCCGGAAGCACTACCAGCCCTACGCCCCTCCC AGGGATTTCGCCGCCTACCGGAGCAAACGGGGCAGAAAGAAACTCCTGTAT ATATTCAAACAACCATTTATGAGGCCAGTACAAACTACTCAAGAGGAAGAT GGCTGTAGCTGCCGATTTCCAGAAGAAGAAGAAGGAGGATGTGAACTGAGA GTGAAGTTCAGCAGGAGCGCAGACGCCCCCGCGTACAAGCAGGGCCAGAAC CAGCTCTATAACGAGCTCAATCTAGGACAAGAGAGGAGTACGATGTTTTG GACAAGCGTAGAGGCCGGGACCCTGAGATGGGGGGAAAGCCGAGAAGGAAG AACCCTCAGGAAGGCCTGTACAATGAACTGCAGAAAGATAAGATGGCGGAG GCCTACAGTGAGATTGGGATGAAAGGCGAGCGCCGGAGGGGCAAGGGCAC GATGGCCTTTACCAGGGACTCAGTACAGCCACCAAGGACACCTACGACGCC CTTCACATGCAGGCCCTGCCCCCTCGCTAG (SEQ ID NO: 221) |

In some embodiments, a CEA scFv comprises a CDR-H1 of EFGMN (SEQ ID NO: 55), a CDR-H2 of WINTKTGEATYVEEFKG (SEQ ID NO: 56), a CDR-H3 of WDFAYYVEAMDY (SEQ ID NO: 57) or WDFAHYFQTMDY (SEQ ID NO: 58), a CDR-L1 of KASQNVGTNVA (SEQ ID NO: 59) or KASAAVGTYVA (SEQ ID NO: 60), a CDR-L2 of SASYRYS (SEQ ID NO: 61) or SASYRKR (SEQ ID NO: 62), and a CDR-L3 of HQYYTYPLFT (SEQ ID NO: 63) or sequences having at least 85% or at least 95% identity thereto. In some embodiments, a CEA scFv comprises a CDR-H1 of EFGMN (SEQ ID NO: 55), a CDR-H2 of WINTKTGEATYVEEFKG (SEQ ID NO: 56), a CDR-H3 of WDFAYYVEAMDY (SEQ ID NO: 57) or WDFAHYFQTMDY (SEQ ID NO: 58), a CDR-L1 of KASQNVGTNVA (SEQ ID NO: 59) or KASAAVGTYVA (SEQ ID NO: 60), a CDR-L2 of SASYRYS (SEQ ID NO: 61) or SASYRKR (SEQ ID NO: 62) and a CDR-L3 of HQYYTYPLFT (SEQ ID NO: 63). In some embodiments, a CEA scFv comprises a CDR-H1 of EFGMN (SEQ ID NO: 55), a CDR-H2 of WINTKTGEATYVEEFKG (SEQ ID NO: 56), a CDR-H3 of WDFAYYVEAMDY (SEQ ID NO: 57), a CDR-L1 of KASQNVGTNVA (SEQ ID NO: 59), a CDR-L2 of SASYRYS (SEQ ID NO: 61) and a CDR-L3 of HQYYTYPLFT (SEQ ID NO: 63). In some embodiments, a CEA scFv comprises a CDR-H1 of EFGMN (SEQ ID NO: 55), a CDR-H2 of WINTKTGEATYVEEFKG (SEQ ID NO: 56), a CDR-H3 of WDFAYYVEAMDY (SEQ ID NO: 57), a CDR-L1 of KASAAVGTYVA (SEQ ID NO: 60), a CDR-L2 of SASYRKR (SEQ ID NO: 62), and a CDR-L3 of HQYYTYPLFT (SEQ ID NO: 63). In some embodiments, a CEA scFv comprises a CDR-H1 of EFGMN (SEQ ID NO: 55), a CDR-H2 of WINTKTGEATYVEEFKG (SEQ ID NO: 56), a CDR-H3 of WDFAHYFQTMDY (SEQ ID NO: 58), a CDR-L1 of KASAAVGTYVA (SEQ ID NO: 60), a CDR-L2 of SASYRKR (SEQ ID NO: 62), and a CDR-L3 of HQYYTYPLFT (SEQ ID NO: 63).

In some embodiments, the extracellular ligand binding domain of the first receptor comprises a variable heavy (VH) portion comprising a set of heavy chain complementarity determining regions (HC-CDRs) selected from the group consisting of SEQ ID NOS: 55-58 and a variable light (VL) portion comprising a set of light chain complementarity determining regions selected from the group consisting of SEQ ID NOS: 59-63; or CDR sequences having at most 1, 2, or 3 substitutions, deletions, or insertions relative to SEQ ID NOS: 55-58 or SEQ ID NOS: 59-63. In some embodiments, the extracellular ligand binding domain of the first receptor comprises a variable heavy (VH) portion comprising a set of heavy chain complementarity determining regions (HC-CDRs) comprising SEQ ID NOS: 55-57 and a variable light (VL) portion comprising a set of light chain complementarity determining regions comprising SEQ ID NOS: 59, 61 and 63; or CDR sequences having at most 1, 2, or 3 substitutions, deletions, or insertions relative to SEQ ID NOS: 55-57 or SEQ ID NOS: 59, 61 and 63. In some embodiments, the extracellular ligand binding domain of the first receptor comprises a variable heavy (VH) portion comprising a set of heavy chain complementarity determining regions (HC-CDRs) comprising SEQ ID NOS: 55-57 and a variable light (VL) portion comprising a set of light chain complementarity determining regions comprising SEQ ID NOS: 59, 61 and 63.

Exemplary scFv that recognize CEA are shown in Table 4 below. Underlining indicates CDR sequences.

TABLE 4

Exemplary scFv that target CEA

| Protein sequence | DNA sequence |
|---|---|
| QVQLQQSGAELVRSGTSVK LSCTASGFNIKDSYMHWLR QGPEQGLEWIGWIDPENGD TEYAPKFQGKATFTTDTSS NTAYLQLSSLTSEDTAVYY CNEGTPTGPYYFDYWGQGT TVTVSSGGGGSGGGGSGG GSGGENVLTQSPAIMSASP GEKVTITCSASSSVSYMHW FQQKPGTSQKLWIYSTSNL ASGVPARFSGSGSGTSYSL TISRMEAEDAATYYCQQRS SYPLTFGAGTKLELK (SEQ ID NO: 64) | CAGGTCCAGCTGCAGCAGTCTGGGGCAGAGCTTGTGAGGTCAGGGACC TCAGTCAAGTTGTCCTGCACAGCTTCTGGCTTCAACATTAAAGACTCC TATATGCACTGGTTGAGGCAGGGGCCTGAACAGGGCCTGGAGTGGATT GGATGGATTGATCCTGAGAATGGTGATACTGAATATGCCCCGAAGTTC CAGGGCAAGGCCACTTTTACTACAGACACATCCTCCAACACAGCCTAC CTGCAGCTCAGCAGCCTGACATCTGAGGACACTGCCGTCTATTACTGT AATGAAGGGACACCGACAGGGCCATACTATTTTGACTACTGGGGTCAA GGAACCACAGTCACCGTGTCCTCAGGCGGAGGTGGAAGCGGAGGGGGA GGATCTGGCGGCGGAGGAAGCGGAGGCGAGAACGTTCTCACCCAGTCT CCAGCAATCATGTCTGCATCTCCAGGGGAGAAGGTCACCATAACCTGC AGTGCCAGCTCAAGTGTAAGTTACATGCACTGGTTCCAGCAGAAGCCA GGCACTTCTCCCAAACTCTGGATTTATAGCACATCCAACCTGGCTTCT GGAGTCCCTGCTCGCTTCAGTGGCAGTGGATCTGGGACCTCTTACTCT CTCACAATCAGCCGAATGGAGGCTGAAGATGCTGCCACTTATTACTGC CAGCAAAGGAGTAGTTACCCGCTCACGTTCGGTGCTGGGACCAAGCTG GAGCTGAAA (SEQ ID NO: 222) |
| QVQLVQSGAEVKKPGASVK VSCKASGFNIKDSYMHWVR QAPGQGLEWMGWIDPENGD TEYAPKFQGRVTMTTDTST STAYMELRSLRSDDTAVYY CNEGTPTGPYYFDYWGQGT TVTVSSGGGGSGGGGSGGG GSGGEIVLTQSPATLSLSP GERATLSCSASSSVSYMHW YQQKPGLAPRLLIYSTSNL ASGIPDRFSGSGSGTDFTL TISRLEPEDFAVYYCQQRS SYPLTFGQGTKLEIK (SEQ ID NO: 65) | CAGGTCCAGCTGGTGCAGTCTGGGGCAGAGGTGAAGAAACCAGGGGCC TCAGTCAAGGTGTCCTGCAAAGCTTCTGGCTTCAACATTAAAGACTCC TATATGCACTGGGTGAGGCAGGCGCCTGGACAGGGCCTGGAGTGGATG GGATGGATTGATCCTGAGAATGGTGATACTGAATATGCCCCGAAGTTC CAGGGCAGGGTCACTATGACTACAGACACATCCACCTCCACAGCCTAC ATGGAGCTCAGGAGCCTGAGATCTGACGACACTGCCGTCTATTACTGT AATGAAGGGACACCGACAGGGCCATACTATTTTGACTACTGGGGTCAA GGAACCACAGTCACCGTGTCTCAGGCGGAGGTGGAAGCGGAGGGGGAG GATCTGGCGGCGGAGGAAGCGGAGGCGAGATCGTTCTCACCCAGTCTC CAGCAACCTTGTCTCTGTCTCCAGGGGAGAGGGCCACCCTAAGCTGCA GTGCCAGCTCAAGTGTAAGTTACATGCACTGGTACCAGCAGAAGCCAG GCCTTGCTCCCAGACTCCTGATTTATAGCACATCCAACCTGGCTTCTG GAATCCCTGATCGCTTCAGTGGCAGTGGATCTGGGACCGATTTCACTC TCACAATCAGCCGACTGGAGCCTGAAGATTTCGCCGTTTATTACTGCC AGCAAAGGAGTAGTTACCCGCTCACGTTCGGTCAGGGGACCAAGCTGG AGATCAAA (SEQ IN NO: 223) |
| EVQLAESGGGLVQPGGSLR LSCAASGFTFSSDAMSWVR QAPGKGLEWVSAISGSGGS TYYADSVKGRFTISRDNSK NTLYLQMNSLRAEDTAVYY CAKSNEFLFDYWGQGTLVT VSSGGGGSGGGGSGGGGSG GSSELTQDPAVSVALGQTV RITCQGDSLRSSYASWYRQ RPGQAPVLVIYGKNNRPSG IPDRFSGSSSGNTASLTIT GAQAEDEADYYWNSSYAWL PYVVFGGGTKLTVLG (SEQ ID NO: 66) | GAGGTGCAGCTGGCGGAGTCTGGGGGAGGCTTGGTACAGCCTGGGGGG TCCCTGAGACTCTCCTGTGCAGCCTCTGGATTCACCTTTAGCAGCGAT GCCATGAGCTGGGTCCGCCAGGCTCCAGGGAAGGGGCTGGAGTGGGTC TCAGCTATTAGTGGTAGTGGTGGTAGCACATACTACGCAGACTCCGTG AAGGGCCGGTTCACCATCTCCAGAGACAATTCCAAGAACACGCTGTAT CTGCAAATGAACAGCCTGAGAGCCGAGGACACGGCCGTGTATTACTGT GCAAAGTCTAATGAGTTTCTTTTTGACTACTGGGGCCAAGGTACCCTG GTCACCGTGTCGAGTGGCGGAGGTGGAAGCGGAGGGGGAGGATCTGGC GGCGGAGGAAGCGGAGGCTCTTCTGAGCTGACTCAGGACCCTGCTGTG TCTGTGGCCTTGGGACAGACAGTCAGGATCACATGCCAAGGAGACAGC CTCAGAAGCTCTTATGCAAGCTGGTACCGGCAGAGGCCAGGACAGGCC CCTGTACTTGTCATCTATGGTAAAAACAACCGGCCCTCAGGGATCCCA GACCGATTCTCTGGCTCCAGCTCAGGAAACACAGCTTCCTTGACCATC ACTGGGGCTCAGGCGGAAGATGAGGCTGACTATTACTGGAACTCCAGC TACGCTTGGCTGCCCTACGTGGTATTCGGCGGAGGGACCAAGCTGACC GTCCTAGGT (SEQ ID NO: 224) |
| QVQLEQSGAGVVKPGASVK LSCKASGFNIKDSYMHWLR QGPGQRLEWIGWIDPENGD TEYAPKFQGKATFTTDTSA NTAYLGLSSLRPEDTAVYY CNEGTPTGPYYFDYWGQGT LVTVSSGGGGSGGGGSGGG GSGGENVLTQSPSSMSVSV | CAGGTCCAGCTGGAGCAGTCTGGGGCAGGGGTTGTGAAGCCAGGGGCC TCAGTCAAGTTGTCCTGCAAAGCTTCTGGCTTCAACATTAAAGACTCC TATATGCACTGGTTGAGGCAGGGGCCTGGACAGCGCCTGGAGTGGATT GGATGGATTGATCCTGAGAATGGTGATACTGAATATGCCCCGAAGTTC CAGGGCAAGGCCACTTTTACTACAGACACATCCGCCAACACAGCCTAC CTGGGGCTCAGCAGCCTGAGACCTGAGGACACTGCCGTCTATTACTGT AATGAAGGGACACCGACAGGGCCATACTATTTTGACTACTGGGGTCAA GGAACCCTAGTCACCGTGTCCTCAGGCGGAGGTGGAAGCGGAGGGGGA |

TABLE 4-continued

Exemplary scFv that target CEA

| Protein sequence | DNA sequence |
|---|---|
| GDRVNIACSASSSVPYMHW LQQKPGKSPKLLIYLTSNL ASGVPSRFSGSGSGTDYSL TISSVQPEDAATYYCQQRS SYPLTFGGGTKLEIK (SEQ ID NO: 67) | GGATCTGGCGGCGGAGGAAGCGGAGGCGAGAACGTTCTCACCCAGTCT CCAAGCTCTATGTCTGTATCTGTCGGGGACAGGGTCAACATCGCCTGC AGTGCCAGCTCAAGTGTACCTTACATGCACTGGCTCCAGCAGAAGCCA GGCAAATCTCCCAAACTCCTGATTTATCTCACATCCAACCTGGCTTCT GGAGTCCCTAGCCGCTTCAGTGGCAGTGGATCTGGGACCGATTACTCT CTCACAATCAGCTCAGTGCAGCCTGAAGATGCTGCCACTTATTACTGC CAGCAAAGGAGTAGTTACCCGCTCACGTTCGGTGGTGGGACCAAGCTG GAGATCAAA (SEQ ID NO: 225) |
| QVQLVQSGSELKKPGASVK VSCKASGYTFTEFGMNWVR QAPGQGLEWMGWINTKTGE ATYVEEFKGRFVFSLDTSV STAYLQISSLKAEDTAVYY CARWDFAYYVEAMDYWGQG TTVTVSSGGGGSGGGGSGG GGSGGDIQMTQSPSSLSAS VGDRVTITCKASQNVGTNV AWYQQKPGKAPKLLIYSAS YRYSGVPSRFSGSGSGTDF TLTISSLQPEDFATYYCHQ YYTYPLFTFGQGTKLEIK (SEQ ID NO: 68) | CAGGTGCAGCTGGTGCAATCTGGGTCTGAGTTGAAGAAGCCTGGGGCC TCAGTGAAGGTTTCCTGCAAGGCTTCTGGATACACCTTCACTGAGTTT GGAATGAACTGGGTGCGACAGGCCCCTGGACAAGGGCTTGAGTGGATG GGATGGATAAACACCAAAACTGGAGAGGCAACATATGTTGAAGAGTTT AAGGGACGGTTTGTCTTCTCCTTGGACACCTCTGTCAGCACGGCATAT CTGCAGATCAGCAGCCTAAAGGCTGAAGCACTGCCGTGTATTACTGT GCGAGATGGGACTTCGCTTATTACGTGGAGGCTATGGACTACTGGGGC CAAGGGACCACGGTGACCGTGTCATCCGGCGGAGGTGGAAGCGGAGGG GGAGGATCTGGCGGCGGAGGAAGCGGAGGCGATATCCAGATGACCCAG TCTCCATCCTCCCTGTCTGCATCTGTGGGAGACAGAGTCACCATCACT TGCAAGGCCAGTCAGAATGTGGGTACTAATGTTGCCTGGTATCAGCAG AAACCAGGGAAAGCACCTAAGCTCCTGATCTATTCGGCATCCTACCGC TACAGTGGAGTCCCATCAAGGTTCAGTGGCAGTGGATCTGGGACAGAT TTCACTCTCACCATCAGCAGTCTGCAACCTGAAGATTTCGCAACTTAC TACTGTCACCAATATTACACCTATCCTCTATTCACGTTTGGCCAGGGC ACCAAGCTCGAGATCAAG (SEQ ID NO: 226) |
| QVQLVQSGAEVKKPGASVK VSCKASGYTKTEFGMNWVR QAPGQGLEWMGWINTKTGE ATYVEEFKGRVTFTTDTST STAYMELRSLRSDDTAVYY CARWDFAYYVEAMDYWGQG TTVTVSSGGGGSGGGGSGG GGSGGDIQMTQSPSSLSAS VGDRVTITCKASAAVGTYV AWYQQKPGKAPKLLIYSAS YRKRGVPSRFSGSGSGTDF TLTISSLQPEDFATYYCHQ YYTYPLFTFGQGTKLEIK (SEQ ID NO: 69) | CAGGTGCAGCTGGTGCAGTCTGGCGCCGAAGTGAAGAAACCTGGAGCT AGTGTGAAGGTGTCCTGCAAGGCCAGCGGCTACACCTTCACCGAGTTC GGCATGAACTGGGTCCGACAGGCTCCAGGCCAGGGCCTCGAATGGATG GGCTGGATCAACACCAAGACCGGCGAGGCCACCTACGTGGAAGAGTTC AAGGGCAGAGTGACCTTCACCACGGACACCAGCACCAGCACCGCCTAC ATGGAACTGCGGAGCCTGAGAAGCGACGACACCGCCGTGTACTACTGC GCRCAGATGGGACTTCGCTTATTACGTGGAAGCCATGGACTACTGGGG CCAGGGCACCACCGTGACCGTGTCTAGCGGCGGAGGTGGAAGCGGAGG GGGAGGATCTGGCGGCGGAGGAAGCGGAGGCGATATCCAGATGACCCA GTCTCCATCCTCCCTGTCTGCATCTGTGGGAGACAGAGTCACCATCAC TTGCAAGGCCAGTGCGGCTGTGGGTACGTATGTTGCGTGGTATCAGCA GAAACCAGGGAAAGCACCTAAGCTCCTGATCTATTCGGCATCCTACCG GAAACCAGGGAAAGCACCTAAGCTCCTGATCTATTCGGCATCCTACCG CAAAAGGGGAGTCCCATCAAGGTTCAGTGGCAGTGGATCTGGGACAGA TTTCACTCTCACCATCAGCAGTCTGCAACCTGAAGATTTCGCAACTTA CTACTGTCACCAATATTACACCTATCCTCTATTCACGTTTGGCCAGGG CACCAAGCTCGAGATCAAG (SEQ ID NO: 227) |
| QVQLVQSGSELKKPGASVK VSCKASGYTFTEFGMNWVR QAPGQGLEWMGWINTKTGE ATYVEEFKGRFVFSLDTSV STAYLQISSLKAEDTAVYY CARWDFAHYFQTMDYWGQG TTVTVSSGGGGSGGGGSGG GGSGGDIQMTQSPSSLSAS VGDRVTITCKASAAVGTYV AWYQQKPGKAPKLLIYSAS YRKRGVPSRFSGSGSGTDF TLTISSLQPEDFATYYCHQ YYTYPLFTFGQGTKLEIK (SEQ ID NO: 70) | CAGGTGCAGCTGGTGCAATCTGGGTCTGAGTTGAAGAAGCCTGGGGCC TCAGTGAAGGTTTCCTGCAAGGCTTCTGGATACACCTTCACTGAGTTT GGAATGAACTGGGTGCGACAGGCCCCTGGACAAGGGCTTGAGTGGATG GGATGGATAAACACCAAAACTGGAGAGGCAACATATGTTGAAGAGTTT AAGGGACGGTTTGTCTTCTCCTTGGACACCTCTGTCAGCACGGCATAT CTGCAGATCAGCAGCCTAAAGGCTGAAGCACTGCCGTGTATTACTGT GCGAGATGGGACTTTGCTCATTACTTTCAGACTATGGACTACTGGGGC CAAGGGACCACGGTCACCGTCTCCTCAGGCGGAGGTGGAAGCGGAGGG GGAGGATCTGGCGGCGGAGGAAGCGGAGGCGATATCCAGATGACCCAG TCTCCATCCTCCCTGTCTGCATCTGTGGGAGACAGAGTCACCATCACT TGCAAGGCCAGTGCGGCTGTGGGTACGTATGTTGCGTGGTATCAGCAG AAACCAGGGAAAGCACCTAAGTCCTGATCTATTCGGCATCCTACCGC AAAAGGGGAGTCCCATCAAGGTTCAGTGGCAGTGGATCTGGGACAGAT TTCACTCTCACCATCAGCAGTCTGCAACCTGAAGATTTCGCAACTTAC TACTGTCACCAATATTACACCTATCCTCTATTCACGTTTGGCCAGGGC ACCAAGCTCGAGATCAAG (SEQ ID NO: 228) |

In some embodiments, a CEA scFv comprises a sequence selected from the group consisting of SEQ ID NOs: 64-70, or a sequence having at least 85%, at least 90%, at least 95%, at least 97% or at least 99% identity thereto. In some embodiments, a CEA scFv comprises, or consists essentially of, a sequence selected from the group consisting of SEQ ID NOs: 64-70. Further exemplary anti-CEA antibody sequences are provided in Stewart et al. *Cancer Immunol. Immunother.* 47:299-306 (1999); WO 1999/043817 A1; US 2002/0018750 A1; US 2011/0104148 A1; US 2016/0108131 A1; US20160075795A1; US 2019/0185583 A1; US 2020/0123270 A1; WO 2020/259550 A1; WO 2021/053587 A1; WO 2021/110647 A1; the contents of which are incorporated by reference herein for the purpose of providing anti-CEA VH, VL, scFv, and/or ligand binding domain sequences.

In some embodiments, the extracellular ligand binding domain of the first receptor comprises a variable heavy (VH) portion comprising SEQ ID NO: 144 or a sequence having at least 85%, at least 90%, at least 95%, at least 97%, or at least 99% identity thereto, and a variable light (VL) portion comprising SEQ ID NO: 148 or a sequence having 85%, at least 90%, at least 95%, at least 97%, or at least 99% identity thereto. In some embodiments, the extracellular ligand binding domain of the first receptor comprises a variable heavy (VH) portion comprising SEQ ID NO: 144, and a variable light (VL) portion comprising SEQ ID NO: 148. In some embodiments, the extracellular ligand binding domain of the first receptor further comprises a linker between VH and VL portions.

In some embodiments, the extracellular ligand binding domain of the first receptor comprises a sequence selected from the group consisting of SEQ ID NOS: 66-70, or a sequence having at least 85%, at least 90%, at least 95%, at least 97%, or at least 99% identity thereto. In some embodiments, the extracellular ligand binding domain of the first receptor comprises an scFv sequence of SEQ ID NO: 68; or a sequence having at least 85%, at least 90%, at least 95%, at least 97% or at least 99% identity thereto. In some embodiments, the extracellular ligand binding domain of the first receptor comprises an scFv sequence of SEQ ID NO: 68.

In some embodiments, one or more (e.g., 1, 2, 3, 4, 5, or 6) amino acid residues in a CDR of the antigen binding domains provided herein are substituted with another amino acid. The substitution may be "conservative" in the sense of being a substitution within the same family of amino acids. The naturally occurring amino acids may be divided into the following four families and conservative substitutions will take place within those families: (1) amino acids with basic side chains: lysine, arginine, histidine; (2) amino acids with acidic side chains: aspartic acid, glutamic acid; (3) amino acids with uncharged polar side chains: asparagine, glutamine, serine, threonine, tyrosine; and (4) amino acids with nonpolar side chains: glycine, alanine, valine, leucine, isoleucine, proline, phenylalanine, methionine, tryptophan, cysteine. By varying the amino acid sequence of the CDRs of an antibody by addition, deletion or substitution of amino acids, various effects such as increased binding affinity for the target antigen may be obtained.

Chimeric Antigen Receptors (CARs)

The disclosure provides a first, activator receptor and immune cells comprising same. In some embodiments, the first receptor is a chimeric antigen receptor.

The term "chimeric antigen receptors (CARs)" as used herein, may refer to artificial receptors derived from T-cell receptors and encompasses engineered receptors that graft an artificial specificity onto a particular immune effector cell. CARs may be employed to impart the specificity of a monoclonal antibody onto a T cell, thereby allowing a large number of specific T cells to be generated, for example, for use in adoptive cell therapy. In specific embodiments, CARs direct specificity of the cell to a tumor associated antigen, for example. Exemplary CARs comprise an intracellular activation domain, a transmembrane domain, and an extracellular domain comprising a tumor associated antigen binding region. In some embodiments, CARs further comprise a hinge domain. In particular aspects, CARs comprise fusions of single-chain variable fragments (scFv) derived from monoclonal antibodies, fused to a CD3 transmembrane domain and endodomain. The specificity of other CAR designs may be derived from ligands of receptors (e.g., peptides). In certain cases, CARs comprise domains for additional co-stimulatory signaling, such as CD3, 4-1BB, FcR, CD27, CD28, CD137, DAP10, and/or OX40. In some cases, molecules can be co-expressed with the CAR, including co-stimulatory molecules, reporter genes for imaging, gene products that conditionally ablate the T cells upon addition of a pro-drug, homing receptors, cytokines, and cytokine receptors.

In some embodiments, the extracellular ligand binding domain of the first receptor is fused to the extracellular domain of a CAR.

In some embodiments, the CARs of the present disclosure comprise an extracellular hinge region. Incorporation of a hinge region can affect cytokine production from CAR-T cells and improve expansion of CAR-T cells in vivo. Exemplary hinges can be isolated or derived from IgD and CD8 domains, for example IgG1. In some embodiments, the hinge is isolated or derived from CD8α or CD28.

In some embodiments, the hinge is isolated or derived from CD8α or CD28. In some embodiments, the CD8α hinge comprises an amino acid sequence having at least 80% identity, at least 90% identity, at least 95% identity, at least 99% identity or is identical to a sequence of TTTPAPRPPT-PAPTIASQPLSLRPEACRPAAGGAVHTRGLDFACD (SEQ ID NO: 71). In some embodiments, the CD8α hinge comprises SEQ ID NO: 71. In some embodiments, the CD8α hinge consists essentially of SEQ ID NO: 71. In some embodiments, the CD8α hinge is encoded by a nucleotide sequence having at least 80% identity, at least 90% identity, at least 95% identity, at least 99% identity or is identical to a sequence of

```
                                         (SEQ ID NO: 72)
ACCACGACGCCAGCGCCGCGACCACCAACACCGGCGCCCACCATCGCGTC

GCAGCCCCTGTCCCTGCGCCCAGAGGCGTGCCGGCCAGCGGCGGGGGCG

CAGTGCACACGAGGGGGCTGGACTTCGCCTGTGAT.
```
In some embodiments, the CD8α hinge is encoded by SEQ ID NO: 72.

In some embodiments, the CD8α hinge is encoded by a nucleotide sequence having at least 80% identity, at least 90% identity, at least 95% identity, at least 99% identity or is identical to a sequence of SEQ ID NO: 156. In some embodiments, the CD8α is encoded by SEQ ID NO: 156.

In some embodiments, the CD28 hinge comprises an amino acid sequence having at least 80% identity, at least 90% identity, at least 95% identity, at least 99% identity or is identical to a sequence of CTIEVMYPPPYLD-NEKSNGTIIHVKGKHLCPSPLFPGPSKP (SEQ ID NO: 73). In some embodiments, the CD28 hinge comprises or consists essentially of SEQ ID NO: 73. In some embodiments, the CD28 hinge is encoded by a nucleotide sequence having at least 80% identity, at least 90% identity, at least 95% identity, at least 99% identity or is identical to a sequence of

```
                                         (SEQ ID NO: 74)
TGTACCATTGAAGTTATGTATCCTCCTCCTTACCTAGACAATGAGAAGA

GCAATGGAACCATTATCCATGTGAAAGGGAAACACCTTTGTCCAAGTCC

CCTATTTCCCGGACCTTCTAAGCCC.
```

In some embodiments, the CD28 hinge is encoded by SEQ ID NO: 74.

The CARs of the present disclosure can be designed to comprise a transmembrane domain that is fused to the extracellular domain of the CAR. In some embodiments, the transmembrane domain that naturally is associated with one of the domains in the CAR is used. For example, a CAR comprising a CD28 co-stimulatory domain might also use a CD28 transmembrane domain. In some instances, the transmembrane domain can be selected or modified by amino acid substitution to avoid binding of such domains to the transmembrane domains of the same or different surface membrane proteins to minimize interactions with other members of the receptor complex.

The transmembrane domain may be derived either from a natural or from a synthetic source. Where the source is natural, the domain may be derived from any membrane-bound or transmembrane protein. Transmembrane regions may be isolated or derived from (i.e. comprise at least the transmembrane region(s) of) the alpha, beta or zeta chain of the T-cell receptor, CD28, CD3 epsilon, CD45, CD4, CD5, CD8, CD9, CD16, CD22, CD33, CD37, CD64, CD80, CD86, CD134, CD137, CD154, or from an immunoglobulin such as IgG4. Alternatively the transmembrane domain may be synthetic, in which case it will comprise predominantly hydrophobic residues such as leucine and valine. In some embodiments, a triplet of phenylalanine, tryptophan and valine will be found at each end of a synthetic transmembrane domain. Optionally, a short oligo- or polypeptide linker, preferably between 2 and 10 amino acids in length may form the linkage between the transmembrane domain and the cytoplasmic signaling domain of the CAR. A glycine-serine doublet provides a particularly suitable linker.

In some embodiments of the CARs of the disclosure, the CARs comprise a CD28 transmembrane domain. In some embodiments, the CD28 transmembrane domain comprises an amino acid sequence having at least 80% identity, at least 90% identity, at least 95% identity, at least 99% identity or is identical to a sequence of FWVLVVVGGVLACYSLL-VTVAFIIFWV (SEQ ID NO: 75). In some embodiments, the CD28 transmembrane domain comprises or consists essentially of SEQ ID NO: 75. In some embodiments, the CD28 transmembrane domain is encoded by a nucleotide sequence having at least 80% identity, at least 90% identity, at least 95% identity, at least 99% identity or is identical to a sequence of (SEQ ID NO: 76)
TTCTGGGTGCTGGTCGTTGTGGGCGGCGTGCTGGCCTGCTACAGCC

TGCTGGTGACAGTGGCCTTCATCATCTTTTGGGTG.

In some embodiments, the CD28 transmembrane domain is encoded by SEQ ID NO: 76. In some embodiments, the CD28 transmembrane domain is encoded by a nucleotide sequence having at least 80% identity, at least 90% identity, at least 95% identity, at least 99% identity or is identical to a sequence of SEQ ID NO: 157. In some embodiments, the CD28 transmembrane domain is encoded by SEQ ID NO: 157.

In some embodiments of the CARs of the disclosure, the CARs comprise an IL-2Rbeta transmembrane domain. In some embodiments, the IL-2Rbeta transmembrane domain comprises an amino acid sequence having at least 80% identity, at least 90% identity, at least 95% identity, at least 99% identity or is identical to a sequence of IPWLGHLL-VGLSGAFGFIILVYLLI (SEQ ID NO: 77). In some embodiments, the IL-2Rbeta transmembrane domain comprises or consists essentially of SEQ ID NO: 77. In some embodiments, the IL-2Rbeta transmembrane domain is encoded by a nucleotide sequence having at least 80% identity, at least 90% identity, at least 95% identity, at least 99% identity or is identical to a sequence of ATTCCGTGGC TCGGCCACCT CCTCGTGGGC CTCAGCGGGG CTTTTGGCTT CATCATCTTA GTGTACTTGC TGATC (SEQ ID NO: 78). In some embodiments, the IL-2Rbeta transmembrane domain is encoded by SEQ ID NO: 78.

The cytoplasmic domain or otherwise the intracellular signaling domain of the CARs of the instant disclosure is responsible for activation of at least one of the normal effector functions of the immune cell in which the CAR has been placed. The term "effector function" refers to a specialized function of a cell. Thus the term "intracellular signaling domain" refers to the portion of a protein which transduces the effector function signal and directs the cell to perform a specialized function. While usually the entire intracellular signaling domain can be employed, in many cases it is not necessary to use the entire domain. To the extent that a truncated portion of the intracellular signaling domain is used, such truncated portion may be used in place of the intact chain as long as it transduces the effector function signal. In some cases, multiple intracellular domains can be combined to achieve the desired functions of the CAR-T cells of the instant disclosure. The term intracellular signaling domain is thus meant to include any truncated portion of one or more intracellular signaling domains sufficient to transduce the effector function signal.

Examples of intracellular signaling domains for use in the CARs of the instant disclosure include the cytoplasmic sequences of the T cell receptor (TCR) and co-receptors that act in concert to initiate signal transduction following antigen receptor engagement, as well as any derivative or variant of these sequences and any synthetic sequence that has the same functional capability.

Accordingly, the intracellular domain of CARs of the instant disclosure comprises at least one cytoplasmic activation domain. In some embodiments, the intracellular activation domain ensures that there is T-cell receptor (TCR) signaling necessary to activate the effector functions of the CAR T-cell. In some embodiments, the at least one cytoplasmic activation is a CD247 molecule (CD3ζ) activation domain, a stimulatory killer immunoglobulin-like receptor (KIR) KIR2DS2 activation domain, or a DNAX-activating protein of 12 kDa (DAP12) activation domain.

In some embodiments, the CD3ζ activation domain comprises an amino acid sequence having at least 80% identity, at least 90% identity, at least 95% identity, at least 99% identity or is identical to a sequence of (SEQ ID NO: 79)
RVKFSRSADAPAYKQGQNQLYNELNLGRREEYDVLDKRRGRDPEMGGKPR

RKNPQEGLYNELQKDKMAEAYSEIGMKGERRRGKGHDGLYQGLSTATKDT

YDALHMQALPPR.

In some embodiments, the CD3ζ activation domain comprises or consists essentially of SEQ ID NO: 79. In some embodiments, the CD3ζ activation domain is encoded by a nucleotide sequence having at least 80% identity, at least 90% identity, at least 95% identity, at least 99% identity or is identical to a sequence of (SEQ ID NO: 80)
AGAGTGAAGTTCAGCAGGAGCGCAGACGCCCCCGCGTACAAGCAGGGCCAGAACCAGCTC-
TATAACGAGCTCAAT

CTAGGACGAAGAGAGGAGTACGATGTTTTGGACAAGCGTAGAGGCCGGGACCCT-
GAGATGGGGGGAAAGCCGAGA

AGGAAGAACCCTCAGGAAGGCCTGTACAATGAACTGCAGAAAGATAAGATGGCGGAGGCC-
TACAGTGAGATTGGG

ATGAAAGGCGAGCGCCGGAGGGGCAAGGGGCACGATGGCCTTTACCAGGGACTCAGTA-
CAGCCACCAAGGACACC

TACGACGCCCTTCACATGCAGGCCCTGCCCCCTCGC.

In some embodiments, the CD3ζ activation domain is encoded by SEQ ID NO: 80. In some embodiments, the CD3ζ activation domain is encoded by a nucleotide sequence having at least 80% identity, at least 90% identity, at least 95% identity, at least 99% identity or is identical to a sequence of SEQ ID NO: 163. In some embodiments, the CD3ζ activation domain is encoded by SEQ ID NO: 163.

It is known that signals generated through the TCR alone are often insufficient for full activation of the T cell and that a secondary or co-stimulatory signal is also required. Thus, T cell activation can be said to be mediated by two distinct classes of cytoplasmic signaling sequence: those that initiate antigen-dependent primary activation through the TCR (primary cytoplasmic signaling sequences) and those that act in an antigen-independent manner to provide a secondary or co-stimulatory signal (secondary cytoplasmic signaling sequences).

Primary cytoplasmic signaling sequences regulate primary activation of the TCR complex either in a stimulatory way, or in an inhibitory way. Primary cytoplasmic signaling sequences that act in a stimulatory manner may contain signaling motifs which are known as immunoreceptor tyrosine-based activation motifs or ITAMs. In some embodiments, the ITAM contains a tyrosine separated from a leucine or an isoleucine by any two other amino acids (YxxL/I (SEQ ID NO: 983). In some embodiments, the cytoplasmic domain contains 1, 2, 3, 4 or 5 ITAMs. An exemplary ITAM containing cytoplasmic domain is the CD3ζ activation domain. Further examples of ITAM containing primary cytoplasmic signaling sequences that can be used in the CARs of the instant disclosure include those derived from TCRζ, FcRγ, FcRβ, CD3γ, CD3δ, CD3ε, CD3ζ, CD5, CD22, CD79a, CD79b, and CD66d.

In some embodiments, the CD3ζ activation domain comprising a single ITAM comprises an amino acid sequence having at least 80% identity, at least 90% identity, at least 95% identity, at least 99% identity or is identical to a sequence of RVKFSRSADAPAYQQGQNQLYNELNLGR-REEYDVLHMQALPPR (SEQ ID NO: 81). In some embodiments, the CD3ζ activation domain comprises SEQ ID NO: 81. In some embodiments, the CD3ζ activation domain comprising a single ITAM consists essentially of an amino acid sequence of RVKFSRSADAPAYQQGQNQLY-NELNLGRREEYDVLHMQALPPR (SEQ ID NO: 81). In some embodiments, the CD3ζ activation domain comprising a single ITAM is encoded by a nucleotide sequence having at least 80% identity, at least 90% identity, at least 95% identity, at least 99% identity or is identical to a sequence of AGAGTGAAGT TCAGCAGGAG CGCAGACGCC CCCGCGTACC AGCAGGGCCA GAACCAGCTC TATAACGAGC TCAATCTAGG ACGAAGAGAG GAGTACGATG TTTTGCACAT GCAGGCCCTG CCCCCTCGC (SEQ ID NO: 82). In some embodiments, the CD3ζ activation domain is encoded by SEQ ID NO: 82.

In some embodiments, the cytoplasmic domain of the CAR can be designed to comprise the CD3ζ signaling domain by itself or combined with any other desired cytoplasmic domain(s) useful in the context of the CAR of the instant disclosure. For example, the cytoplasmic domain of the CAR can comprise a CD3 chain portion and a co-stimulatory domain. The co-stimulatory domain refers to a portion of the CAR comprising the intracellular domain of a costimulatory molecule. A costimulatory molecule is a cell surface molecule other than an antigen receptor or its ligands that is required for an efficient response of lymphocytes to an antigen. Examples of such molecules include the co-stimulatory domain is selected from the group consisting of IL-2RP, Fc Receptor gamma (FcRγ), Fc Receptor beta (FcRβ), CD3g molecule gamma (CD3γ), CD3δ, CD3ε, CD5 molecule (CD5), CD22 molecule (CD22), CD79a molecule (CD79a), CD79b molecule (CD79b), carcinoembryonic antigen related cell adhesion molecule 3 (CD66d), CD27 molecule (CD27), CD28 molecule (CD28), TNF receptor superfamily member 9 (4-1BB), TNF receptor superfamily member 4 (OX40), TNF receptor superfamily member 8 (CD30), CD40 molecule (CD40), programmed cell death 1 (PD-1), inducible T cell costimulatory (ICOS), lymphocyte function-associated antigen-1 (LFA-1), CD2 molecule (CD2), CD7 molecule (CD7), TNF superfamily member 14 (LIGHT), killer cell lectin like receptor C2 (NKG2C) and CD276 molecule (B7-H3) c-stimulatory domains, or functional variants thereof. In some embodiments, the intracellular domains of CARs of the instant disclosure comprise at least one co-stimulatory domain. In some embodiments, the co-stimulatory domain is isolated or derived from CD28.

In some embodiments, the intracellular domains of CARs of the instant disclosure comprise at least one co-stimulatory domain. In some embodiments, the co-stimulatory domain is isolated or derived from CD28. In some embodiments, the CD28 co-stimulatory domain comprises an amino acid sequence having at least 80% identity, at least 90% identity, at least 95% identity, at least 99% identity or is identical to a sequence of RSKRSRLLHSDYMNMTPRRPGP-TRKHYQPYAPPRDFAAYRS (SEQ ID NO: 83). In some embodiments, the CD28 co-stimulatory domain comprises or consists essentially of SEQ ID NO: 83). In some embodiments, the CD28 co-stimulatory domain is encoded by a nucleotide sequence having at least 80% identity, at least 90% identity, at least 95% identity, at least 99% identity or is identical to a sequence of (SEQ ID NO: 84)
AGGAGCAAGCGGAGCAGACTGCTGCACAGCGACTACATGAACATGACCC

CCCGGAGGCCTGGCCCCACCCGGAAGCACTACCAGCCCTACGCCCCTCC

CAGGGATTTCGCCGCCTACCGGAGC.

In some embodiments, the CD28 co-stimulatory domain is encoded by SEQ ID NO: 84. In some embodiments, the CD28 co-stimulatory domain is encoded by a nucleotide sequence having at least 80% identity, at least 90% identity, at least 95% identity, at least 99% identity or is identical to a sequence of SEQ ID NO: 160. In some embodiments, the CD28 co-stimulatory domain is encoded by SEQ ID NO: 160.

In some embodiments, the co-stimulatory domain is isolated or derived from 4-1BB. In some embodiments, the 4-1BB co-stimulatory domain comprises an amino acid sequence having at least 80% identity, at least 90% identity, at least 95% identity, at least 99% identity or is identical to a sequence of KRGRKKLLY-IFKQPFMRPVQTTQEEDGCSCRFPEEEEGGCEL (SEQ ID NO: 161). In some embodiments, the 4-1BB co-stimulatory domain comprises or consists essentially of KRGRKKLLY-IFKQPFMRPVQTTQEEDGCSCRFPEEEEGGCEL (SEQ ID NO: 161). In some embodiments, the 4-1BB co-stimulatory domain s encoded by a nucleotide sequence having at least 80% identity, at least 90% identity, at least 95% identity, at least 99% identity or is identical to a sequence of (SEQ ID NO: 162)
AAACGGGGCAGAAAGAAACTCCTGTATATATTCAAACAACCATTTATGAG

GCCAGTACAAACTACTCAAGAGGAAGATGGCTGTAGCTGCCGATTTCCAG

AAGAAGAAGAAGGAGGATGTGAACTG.

In some embodiments, the intracellular domain of the CAR comprises a CD28 co-stimulatory domain, a 4-1BB costimulatory domain, and a CD3ζ activation domain. In some embodiments, the intracellular domain of the CAR comprises a sequence of (SEQ ID NO: 158)
RSKRSRLLHSDYMNMTPRRPGPTRKHYQPYAPPRDFAAYRSKRGRKKLLYF

IFKQPMRPVQTTQEEDGCSCRFPEEEEGGCELRVKFSRSADAPAYKQGQNQ

LYNELNLGRREEYDVLDKRRGRDPEMGGKPRRKNPOEGLYNELOKDKMAEA

YSEIGMKGERRRGKGHDGLYQGLSTATKDTYDALHMQALPPR, or a sequence having at least 80% identity, at least 90% identity, at least 95% identity, at least 99% identity thereto. In some embodiments, the intracellular domain of the CAR is encoded by SEQ ID NO: 159, or a sequence having at least 80% identity, at least 90% identity, at least 95% identity, at least 99% identity thereto. In some embodiments, the intracellular domain of the CAR is encoded by SEQ ID NO: 159.

The cytoplasmic domains within the cytoplasmic signaling portion of the CARs of the instant disclosure may be linked to each other in a random or specified order. Optionally, a short oligo- or polypeptide linker, for example between 2 and 10 amino acids in length may form the linkage. A glycine-serine doublet provides an example of a suitable linker. An exemplary linker comprises a sequence of GGGGSGGGGSGGGGSGG (SEQ ID NO: 146).

The cytoplasmic domains within the cytoplasmic signaling portion of the CARs of the instant disclosure may be linked to each other in a random or specified order. Optionally, a short oligo- or polypeptide linker, for example between 2 and 10 amino acids in length may form the linkage. A glycine-serine doublet provides an example of a suitable linker.

T Cell Receptors (TCRs)

The disclosure provides a first, activator receptor and immune cells comprising same. In some embodiments, the first receptor is a T cell receptor (TCR).

Exemplary TCRs comprising intracellular domains for use in the instant disclosure are described in PCT/US2020/045250 filed on Sep. 6, 2020, the contents of which are incorporated herein by reference.

As used herein, a "TCR", sometimes also called a "TCR complex" or "TCR/CD3 complex" refers to a protein complex comprising a TCR alpha chain, a TCR beta chain, and one or more of the invariant CD3 chains (zeta, gamma, delta and epsilon), sometimes referred to as subunits. The TCR alpha and beta chains can be disulfide-linked to function as a heterodimer to bind to peptide-MHC complexes. Once the TCR alpha/beta heterodimer engages peptide-MHC, conformational changes in the TCR complex in the associated invariant CD3 subunits are induced, which leads to their phosphorylation and association with downstream proteins, thereby transducing a primary stimulatory signal. In an exemplary TCR complex, the TCR alpha and TCR beta polypeptides form a heterodimer, CD3 epsilon and CD3 delta form a heterodimer, CD3 epsilon and CD3 gamma for a heterodimer, and two CD3 zeta form a homodimer.

Any suitable ligand binding domain may be fused to an extracellular domain, hinge domain or transmembrane of the TCRs described herein. For example, the ligand binding domain can be an antigen binding domain of an antibody or TCR, or comprise an antibody fragment, a VP only domain, a linear antibody, a single-chain variable fragment (scFv), or a single domain antibody (sdAb).

In some embodiments, the ligand binding domain is fused to one or more extracellular domains or transmembrane domains of one or more TCR subunits. The TCR subunit can be TCR alpha, TCR beta, CD3 delta, CD3 epsilon, CD3 gamma or CD3 zeta. For example, the ligand binding domain can be fused to TCR alpha, or TCR beta, or portions of the ligand binding can be fused to two subunits, for example portions of the ligand binding domain can be fused to both TCR alpha and TCR beta.

TCR subunits include TCR alpha, TCR beta, CD3 zeta, CD3 delta, CD3 gamma and CD3 epsilon. Any one or more of TCR alpha, TCR beta chain, CD3 gamma, CD3 delta, CD3 epsilon, or CD3 zeta, or fragments or derivative thereof, can be fused to one or more domains capable of providing a stimulatory signal of the disclosure, thereby enhancing TCR function and activity.

TCR transmembrane domains isolated or derived from any source are envisaged as within the scope of the disclosure. The transmembrane domain may be derived either from a natural or from a recombinant source. Where the source is natural, the domain may be derived from any membrane-bound or transmembrane protein.

In some embodiments, the transmembrane domain is capable of signaling to the intracellular domain(s) whenever the TCR complex has bound to a target. A transmembrane domain of particular use may include at least the transmembrane region(s) of e.g., the alpha, beta or zeta chain of the TCR, CD3 delta, CD3 epsilon or CD3 gamma, CD28, CD3 epsilon, CD45, CD4, CD5, CD8, CD9, CD16, CD22, CD33, CD37, CD64, CD80, CD86, CD134, CD137, CD154.

In some embodiments, the transmembrane domain can be attached to the extracellular region of a polypeptide of the TCR, e.g., the antigen binding domain of the TCR alpha or beta chain, via a hinge, e.g., a hinge from a human protein. For example, the hinge can be a human immunoglobulin (Ig) hinge, e.g., an IgG4 hinge, or a CD8α hinge. In some embodiments, the hinge is isolated or derived from CD8α or CD28.

In some embodiments, the extracellular ligand binding domain is attached to one or more transmembrane domains of the TCR. In some embodiments, the transmembrane domain comprises a TCR alpha transmembrane domain, a TCR beta transmembrane domain, or both. In some embodiments, the transmembrane comprises a CD3 zeta transmembrane domain.

A transmembrane domain can include one or more additional amino acids adjacent to the transmembrane region, e.g., one or more amino acid associated with the extracellular region of the protein from which the transmembrane was derived (e.g., 1, 2, 3, 4, 5, 6, 7, 8, 9, 10 or up to 15 amino acids of the extracellular region) and/or one or more additional amino acids associated with the intracellular region of the protein from which the transmembrane protein is derived (e.g., 1, 2, 3, 4, 5, 6, 7, 8, 9, 10 or up to 15 amino acids of the intracellular region).

In some embodiments, the transmembrane domain can be selected or modified by amino acid substitution to avoid binding of such domains to the transmembrane domains of the same or different surface membrane proteins, e.g., to minimize interactions with other members of the receptor complex.

When present, the transmembrane domain may be a natural TCR transmembrane domain, a natural transmembrane domain from a heterologous membrane protein, or an artificial transmembrane domain. The transmembrane domain may be a membrane anchor domain. Without limitation, a natural or artificial transmembrane domain may comprise a hydrophobic a-helix of about 20 amino acids, often with positive charges flanking the transmembrane segment. The transmembrane domain may have one transmembrane segment or more than one transmembrane segment. Prediction of transmembrane domains/segments may be made using publicly available prediction tools (e.g. TMHMM, Krogh et al. Journal of Molecular Biology 2001; 305(3):567-580; or TMpred, Hofmann & Stoffel Biol. Chem. Hoppe-Seyler 1993; 347: 166). Non-limiting examples of membrane anchor systems include platelet derived growth factor receptor (PDGFR) transmembrane domain, glycosylphosphatidylinositol (GPI) anchor (added post-translationally to a signal sequence) and the like.

In some embodiments, the transmembrane domain comprises a TCR alpha transmembrane domain. In some embodiments, the TCR alpha transmembrane domain comprises an amino acid sequence having at least 85% identity, at least 90% identity, at least 95% identity, at least 96% identity, at least 97% identity, at least 98% identity, at least 99% identity or is identical to a sequence of: VIGFRILLLKVAGFNLLMTLRLW (SEQ ID NO: 85). In some embodiments, the TCR alpha transmembrane domain comprises, or consists essentially of, SEQ ID NO: 85. In some embodiments, the TCR alpha transmembrane domain is encoded by a sequence of

```
                                        (SEQ ID NO: 86)
GTGATTGGGTTCCGAATCCTCCTCCTGAAAGTGGCCGGGTTTAATCTG

CTCATGACGCTGCGGCTGTGG.
```

In some embodiments, the transmembrane domain comprises a TCR beta transmembrane domain. In some embodiments, the TCR beta transmembrane domain comprises an amino acid sequence having at least 85% identity, at least 90% identity, at least 95% identity, at least 96% identity, at least 97% identity, at least 98% identity, at least 99% identity or is identical to a sequence of: TILYEILLGKATLYAVLVSALVL (SEQ ID NO: 87). In some embodiments, the TCR beta transmembrane domain comprises, or consists essentially of, SEQ ID NO: 87. In some embodiments, the TCR beta transmembrane domain is encoded by a sequence of

```
                                        (SEQ ID NO: 88)
ACCATCCTCTATGAGATCTTGCTAGGGAAGGCCACCTTGTATGCCGT

GCTGGTCAGTGCCCTCGTGCTG.
```

TCRs of the disclosure can comprise one or more intracellular domains. In some embodiments, the intracellular domain comprises one or more domains capable of providing a stimulatory signal to a transmembrane domain. In some embodiments, the intracellular domain comprises a first intracellular domain capable of providing a stimulatory signal and a second intracellular domain capable of providing a stimulatory signal. In other embodiments, the intracellular domain comprises a first, second and third intracellular domain capable of providing a stimulatory signal. The intracellular domains capable of providing a stimulatory signal are selected from the group consisting of a CD28 molecule (CD28) domain, a LCK proto-oncogene, Src family tyrosine kinase (Lck) domain, a TNF receptor superfamily member 9 (4-1BB) domain, a TNF receptor superfamily member 18 (GITR) domain, a CD4 molecule (CD4) domain, a CD8a molecule (CD8a) domain, a FYN proto-oncogene, Src family tyrosine kinase (Fyn) domain, a zeta chain of T cell receptor associated protein kinase 70 (ZAP70) domain, a linker for activation of T cells (LAT) domain, lymphocyte cytosolic protein 2 (SLP76) domain, (TCR) alpha, TCR beta, CD3 delta, CD3 gamma and CD3 epsilon intracellular domains.

In some embodiments, an intracellular domain comprises at least one intracellular signaling domain. An intracellular signaling domain generates a signal that promotes a function a cell, for example an immune effector function of a TCR containing cell, e.g., a TCR-expressing T-cell. In some embodiments, the intracellular domain of the first receptor of the disclosure includes at least one intracellular signaling domain. For example, the intracellular domains of CD3 gamma, delta or epsilon comprise signaling domains.

In some embodiments, the extracellular domain, transmembrane domain and intracellular domain are isolated or derived from the same protein, for example T-cell receptor (TCR) alpha, TCR beta, CD3 delta, CD3 gamma, CD3 epsilon or CD3 zeta.

Examples of intracellular domains for use in activator receptors of the disclosure include the cytoplasmic sequences of the TCR alpha, TCR beta, CD3 zeta, and 4-1BB, and the intracellular signaling co-receptors that act in concert to initiate signal transduction following antigen receptor engagement, as well as any derivative or variant of these sequences and any recombinant sequence that has the same functional capability.

In some embodiments, the intracellular signaling domain comprises a primary intracellular signaling domain. Exemplary primary intracellular signaling domains include those derived from the proteins responsible for primary stimulation, or antigen dependent stimulation.

In some embodiments, the intracellular domain comprises a CD3 delta intracellular domain, a CD3 epsilon intracellular domain, a CD3 gamma intracellular domain, a CD3 zeta intracellular domain, a TCR alpha intracellular domain or a TCR beta intracellular domain.

In some embodiments, the intracellular domain comprises a TCR alpha intracellular domain. In some embodiments, a TCR alpha intracellular domain comprises Ser-Ser. In some embodiments, a TCR alpha intracellular domain is encoded by a sequence of TCCAGC.

In some embodiments, the intracellular domain comprises a TCR beta intracellular domain. In some embodiments, the TCR beta intracellular domain comprises an amino acid sequence having at least 80% identity, at least 90% identity, or is identical to a sequence of: MAMVKRKDSR (SEQ ID NO: 89). In some embodiments, the TCR beta intracellular domain comprises, or consists essentially of SEQ ID NO: 89. In some embodiments, the TCR beta intracellular domain is encoded by a sequence of

```
                                        (SEQ ID NO: 90)
ATGGCCATGGTCAAGAGAAAGGATTCCAGA.
```

In some embodiments, the intracellular signaling domain comprises at least one stimulatory intracellular domain. In some embodiments, the intracellular signaling domain comprises a primary intracellular signaling domain, such as a CD3 delta, CD3 gamma and CD3 epsilon intracellular domain, and one additional stimulatory intracellular domain, for example a co-stimulatory domain. In some embodiments, the intracellular signaling domain comprises a primary intracellular signaling domain, such as a CD3 delta, CD3 gamma and CD3 epsilon intracellular domain, and two additional stimulatory intracellular domains.

Exemplary co-stimulatory intracellular signaling domains include those derived from proteins responsible for costimulatory signals, or antigen independent stimulation. Co-stimulatory molecules include, but are not limited to an MHC class I molecule, BTLA, a Toll ligand receptor, as well as DAP10, DAP12, CD30, LIGHT, OX40, CD2, CD27, CDS, ICAM-1, LFA-1 (CD11a/CD18) 4-1BB (CD137, TNF receptor superfamily member 9), and CD28 molecule (CD28). A co-stimulatory protein can be represented in the following protein families: TNF receptor proteins, Immunoglobulin-like proteins, cytokine receptors, integrins, signaling lymphocytic activation molecules (SLAM proteins), and activating NK cell receptors. Examples of such molecules include CD27, CD28, 4-1BB (CD137), OX40, GITR, CD30, CD40, ICOS, BAFFR, HVEM, lymphocyte function-associated antigen-1 (LFA-1), CD2, CD7, LIGHT, NKG2C, SLAMF7, NKp80, CD160, B7-H3, a ligand that specifically binds with CD83, CD4, and the like. The co-stimulatory domain can comprise the entire intracellular portion, or the entire native intracellular signaling domain, of the molecule from which it is derived, or a functional variant thereof.

In some embodiments, the stimulatory domain comprises a co-stimulatory domain. In some embodiments, the co-stimulatory domain comprises a CD28 or 4-1BB co-stimulatory domain. CD28 and 4-1BB are well characterized co-stimulatory molecules required for full T cell activation and known to enhance T cell effector function. For example, CD28 and 4-1BB have been utilized in chimeric antigen receptors (CARs) to boost cytokine release, cytolytic function, and persistence over the first-generation CAR containing only the CD3 zeta signaling domain. Likewise, inclusion of co-stimulatory domains, for example CD28 and 4-1BB domains, in TCRs can increase T cell effector function and specifically allow co-stimulation in the absence of co-stimulatory ligand, which is typically down-regulated on the surface of tumor cells. In some embodiments, the stimulatory domain comprises a CD28 intracellular domain or a 4-1BB intracellular domain.

Inhibitory Receptors

The disclosure provides a second receptor, comprising an extracellular ligand binding domain specific to a non-target antigen that has been lost in a cancer cell, such as an allelic variant of a gene. The non-target allelic variant can be lost in the cancer cell through any mechanism, such as, without limitation, epigenetic changes that effect non-target allelic variant expression, mutations to the gene encoding the non-target allelic variant, disruption of cellular signaling that regulates expression of the non-target allelic variant, chromosome loss, partial or complete deletion of the genomic locus, gene silencing through modification of nucleic acids or heterochromatin, or loss of expression through other mechanisms. In variations of the compositions and methods disclosed herein, the cells or subject treated may exhibit a loss of expression of the non-target allelic variant because of non-genetic changes. Accordingly the disclosure provides compositions and methods for killing cells and/or treating subject lacking expression of the non-target antigen from any cause, including but not limited to, loss of heterozygosity.

The non-target antigen can be a protein, or an antigen peptide thereof in a complex with a major histocompatibility complex class I (MHC-I), where the non-target antigen comprises a polymorphism. Because the non-target antigen is polymorphic, loss of a single copy of the gene encoding the non-target antigen, which may occur through loss of heterozygosity in a cancer cell, yields a cancer cell that retains the other polymorphic variant of gene, but has lost the non-target antigen. For example, a subject having HLA-A*02 and HLA-A*01 alleles at the HLA locus may have a cancer in which only the HLA-A*02 allele is lost. In such a subject, the HLA-A*01 protein remains present, but is not recognized by the inhibitory receptor of immune cells encountering the cancer cell, because the inhibitor receptor is designed to be specific to the HLA-A*02 (or other non-target antigen). In normal non-malignant cells, the HLA-A*02 (or other non-target antigen) is present and inhibits activation of the engineered immune cell. In cancer cells having loss of heterozygosity, the HLA-A*02 allelic variant (or other non-target antigen) is lost. Immune cells engineered to express the inhibitory receptor do not receive an inhibitory signal from the inhibitory receptor, as the inhibitory receptor only responds to the HLA-A*02 (or other non-target antigen), which is absent on cancer cells. By this mechanism, the immune cell is selectively activated, and selectively kills, cancer cells expressing CEA but having lost HLA-A*02 (or another non-target antigen) due to loss-of-heterozygosity. HLA-A is used here as an example. Similar polymorphic variation occurs in the population at other MHC genes and in other non-MHC genes as well. Accordingly, disclosure provides a second receptor, comprising an extracellular ligand binding domain specific to a non-target antigen selected from TNFRSF11A, ACHRB, ITGAE, TRPV1, and SREC, or an antigen peptide thereof in a complex with a major histocompatibility complex class I (MHC-I), wherein the non-target antigen comprises a polymorphism, and immune cells comprising same.

In some embodiments, the second receptor is an inhibitory chimeric antigen receptor (inhibitory receptor).

In some embodiments, the second receptor is an inhibitory receptor. In some embodiments, the second receptor is humanized.

In some embodiments, the second receptor comprises SEQ ID NO: 164, or a sequence sharing at least 75%, at least 80%, at least 85%, at least 90%, at least 95%, or at least 98% identity thereto. In some embodiments, 174 or a sequence sharing at least 75%, at least 80%, at least 85%, at least 90%, at least 95%, or at least 98% identity thereto.

The disclosure provides a second receptor, which is an inhibitory receptor, comprising an extracellular ligand binding that can discriminate between single amino-acid variant alleles of a non-target antigen. This ability to discriminate between allelic variants of a non-target antigen allows the second receptor to inhibit activation of immune cells comprising the second receptor in the presence of non-target cells that express that the allele recognized by the ligand binding domain. However, activation of immune cells is not inhibited in the presence of target cells that have lost the allele, for example cancer cells that have lost one allele of a gene through loss of heterozygosity.

The disclosure provides a second receptor, which is an inhibitory receptor, comprising an extracellular ligand binding that can discriminate between different levels of expression of a non-target antigen. This allows the second receptor to inhibit activation of immune cells comprising the second receptor in the presence of non-target cells that express the ligand for the second receptor, but to allow activation of immune cells in the presence of cancer cells that express low levels, or have no expression, of the ligand for the second receptor.

Inhibitor Ligands

In some embodiments, the non-target antigen is not expressed by the target cells, and is expressed by non-target cells. In some embodiments, the non-target antigen is expressed by healthy cells, i.e. cells that are not cancer cells. In some embodiments, the target cells are a plurality of cancer cells that have lost expression of the non-target antigen through loss of heterozygosity (LOH). In some embodiments, the non-target cells are a plurality of healthy cells (i.e. non-cancer, normal, or healthy cells), that express both the target and the non-target antigen.

Any cell surface molecule expressed by the non-target cells that is not expressed by target cells may be a suitable non-target antigen for the second receptor extracellular ligand binding domain. For example, a cell adhesion molecule, a cell-cell signaling molecule, an extracellular domain, a molecule involved in chemotaxis, a glycoprotein, a G protein-coupled receptor, a transmembrane, a receptor for a neurotransmitter or a voltage gated ion channel can be used as a non-target antigen.

In some embodiments, the non-target antigen is selected from the group consisting of a polymorphic variant of TNFRSF11A, ACHRB, ITGAE, TRPV1, and SREC. In some embodiments, the non-target antigen is an antigen peptide comprising a polymorphic residue of TNFRSF11A, ACHRB, ITGAE, TRPV1, or SREC, in a complex with a major histocompatibility complex class I (MHC-I).

In some embodiments, the target antigen is a peptide antigen of a cancer cell-specific antigen in a complex with a major histocompatibility complex class I (MHC-I).

Non-target MHC-1 (pMHC) antigens comprising any of HLA-A, HLA-B, HLA-C or HLA-E are envisaged as within the scope of the disclosure.

In some embodiments, the non-target antigen comprises a Major Histocompatibility Complex (MHC) protein. In some embodiments, the MHC is MHC class I. In some embodiments, the MHC class I protein comprises a human leukocyte antigen (HLA) protein. In some embodiments, the non-target antigen comprises an allele of an HLA Class I protein selected from the group consisting of HLA-A, HLA-B, HLA-C, or HLA-E. In some embodiments, the HLA-A allele comprises HLA-A*01, HLA-A*02, HLA-A*03 or HLA-A*11. In some embodiments, the HLA-B allele comprises HLA-B*07. In some embodiments, the HLA-C allele comprises HLA-C*07.

In some embodiments, the non-target antigen comprises HLA-A. In some embodiments, the non-target antigen comprises an allele of HLA-A. in some embodiments, the allele of HLA-A comprises HLA-A*01, HLA-A*02, HLA-A*03 or HLA-A*11. In some embodiments, the non-target antigen comprises HLA-A*69.

In some embodiments, the non-target antigen comprises an allele HLA-B. In some embodiments, the allele of HLA-B comprises HLA-B*T11.

In some embodiments, the non-target antigen comprises an allele of HLA-C. In some embodiments, the HLA-C allele comprises HLA-C*07.

In some embodiments, the non-target antigen is selected from the group consisting of TNFRSF11A, ACHRB, ITGAE, TRPV1, and SREC. CEA and TNFRSF11A (RANK) are low/absent in T cells, thus avoiding the in cis challenges of other ligands. LOH frequencies for the TNFRSF1TA locus are extremely high (~90% in rectal cancer).

In some embodiments, the non-target antigen comprises TNFRSF1TA or an antigen peptide thereof in a complex with MHC-I. Human TNFRSF1TA is located on ChrT8q: 35,237,593-37,208,541 and is frequently lost through LOH in colorectal cancer cells.

A wild type Human TNFRSF1TA isoform 1 is described in NCBI record number NP_003830.1 the contents of which are incorporated by reference herein in their entirety. In some embodiments, TNFRSF1TA comprises an amino acid sequence of (SEQ ID NO: 13)

```
  1 MAPRARRRRP LFALLLLCAL LARLQVALQI APPCTSEKHY EHLGRCCNKC EPGKYMSSKC

61 TTTSDSVCLP CGPDEYLDSW NEEDKCLLHK VCDTGKALVA VVAGNSTTPR RCACTAGYHW

121 SQDCECCRRN TECAPGLGAQ HPLQLNKDTV CKPCLAGYFS DAFSSTDKCR PWTNCTFLGK

181 RVEHHGTEKS DAVCSSSLPA RKPPNEPHVY LPGLIILLLF ASVALVAAII FGVCYRKKGK

241 ALTANLWHWI NEACGRLSGD KESSGDSCVS THTANFGQQG ACEGVLLLTL EEKTFPEDMC

301 YPDQGGVCQG TCVGGGPYAQ GEDARMLSLV SKTEIEEDSF RQMPTEDEYM DRPSQPTDQL

361 LFLTEPGSKS TPPFSEPLEV GENDSLSQCF TGTQSTVGSE SCNCTEPLCR TDWTPMSSEN

421 YLQKEVDSGH CPHWAASPSP NWADVCTGCR NPPGEDCEPL VGSPKRGPLP QCAYGMGLPP

481 EEEASRTEAR DQPEDGADGR LPSSARAGAG SGSSPGGQSP ASGNVTGNSN STFISSGQVM

541 NFKGDIIVVY VSQTSQEGAA AAAEPMGRPV QEETLARRDS FAGNGPRFPD PCGGPEGLRE

601 PEKASRPVQE QGGAKA.
```

In some embodiments, TNFRSF11A comprises a sequence that shares at least 80%, at least 85%, at least 90%, at least 95%, at least 96%, at least 97%, at least 98%, or at least 99% identity to SEQ ID NO: 13. Polymorphic residues of TNFRSF11A are marked as bold and underlined in SEQ ID NO: 13.

In some embodiments, the non-target antigen comprises a polymorphism of TNFRSF11A. For example, the non-target antigen comprises a peptide derived from TNFRSF11A comprising a polymorphic residue of TNFRSF11A. Polymorphic residues of TNFRSF11A include amino acid residues 141 and 192 of SEQ ID NO: 13. In some embodiments, the non-target antigen comprises a peptide of TNFRSF11A comprising amino acid 141 (rs35211496, H141Y) or 192 (rs1805034, V192A) of SEQ ID NO: 13.

In some embodiments, the polymorphism of TNFRSF11A comprises an H141/A192V allele of TNFRSF11A. In some embodiments, the polymorphism of TNFRSF11A comprises a sequence of:

```
(polymorphic amino acids are bold and underlined)
                                                          (SEQ ID NO: 229)
  1 MAPRARRRRP LFALLLLCAL LARLQVALQI APPCTSEKHY EHLGRCCNKC EPGKYMSSKC

61 TTTSDSVCLP CGPDEYLDSW NEEDKCLLHK VCDTGKALVA VVAGNSTTPR RCACTAGYHW

121 SQDCECCRRN TECAPGLGAQ HPLQLNKDTV CKPCLAGYFS DAFSSTDKCR PWTNCTFLGK

181 RVEHHGTEKS DVVCSSSLPA RKPPNEPHVY LPGLIILLLF ASVALVAAII FGVCYRKKGK

241 ALTANLWHWI NEACGRLSGD KESSGDSCVS THTANFGQQG ACEGVLLLTL EEKTFPEDMC

301 YPDQGGVCQG TCVGGGPYAQ GEDARMLSLV SKTEIEEDSF RQMPTEDEYM DRPSQPTDQL

361 LFLTEPGSKS TPPFSEPLEV GENDSLSQCF TGTQSTVGSE SCNCTEPLCR TDWTPMSSEN

421 YLQKEVDSGH CPHWAASPSP NWADVCTGCR NPPGEDCEPL VGSPKRGPLP QCAYGMGLPP

481 EEEASRTEAR DQPEDGADGR LPSSARAGAG SGSSPGGQSP ASGNVTGNSN STFISSGQVM

541 NFKGDIIVVY VSQTSQEGAA AAAEPMGRPV QEETLARRDS FAGNGPRFPD PCGGPEGLRE

601 PEKASRPVQE QGGAKA.
```

In some embodiments, the polymorphism of TNFRSF11A comprises an H141Y/A192 allele of TNFRSF11A. In some embodiments, the polymorphism of TNFRSF11A comprises a sequence of:

```
(polymorphic amino acids are bold and underlined)
                                                          (SEQ ID NO: 230)
  1 MAPRARRRRP LFALLLLCAL LARLQVALQI APPCTSEKHY EHLGRCCNKC EPGKYMSSKC

61 TTTSDSVCLP CGPDEYLDSW NEEDKCLLHK VCDTGKALVA VVAGNSTTPR RCACTAGYHW

121 SQDCECCRRN TECAPGLGAQ YPLQLNKDTV CKPCLAGYFS DAFSSTDKCR PWTNCTFLGK

181 RVEHHGTEKS DAVCSSSLPA RKPPNEPHVY LPGLIILLLF ASVALVAAII FGVCYRKKGK

241 ALTANLWHWI NEACGRLSGD KESSGDSCVS THTANFGQQG ACEGVLLLTL EEKTFPEDMC

301 YPDQGGVCQG TCVGGGPYAQ GEDARMLSLV SKTEIEEDSF RQMPTEDEYM DRPSQPTDQL

361 LFLTEPGSKS TPPFSEPLEV GENDSLSQCF TGTQSTVGSE SCNCTEPLCR TDWTPMSSEN

421 YLQKEVDSGH CPHWAASPSP NWADVCTGCR NPPGEDCEPL VGSPKRGPLP QCAYGMGLPP

481 EEEASRTEAR DQPEDGADGR LPSSARAGAG SGSSPGGQSP ASGNVTGNSN STFISSGQVM

541 NFKGDIIVVY VSQTSQEGAA AAAEPMGRPV QEETLARRDS FAGNGPRFPD PCGGPEGLRE

601 PEKASRPVQE QGGAKA.
```

In some embodiments, the polymorphism of TNFRSF11A comprises an H141Y/A192V allele of TNFRSF1TA. In some embodiments, the polymorphism of TNFRSF1TA comprises a sequence of

```
(polymorphic amino acids are bold and underlined)
                                                          (SEQ ID NO: 231)
  1 MAPRARRRRP LFALLLLCAL LARLQVALQI APPCTSEKHY EHLGRCCNKC EPGKYMSSKC

61 TTTSDSVCLP CGPDEYLDSW NEEDKCLLHK VCDTGKALVA VVAGNSTTPR RCACTAGYHW
```

```
121 SQDCECCRRN TECAPGLGAQ YPLQLNKDTV CKPCLAGYFS DAFSSTDKCR PWTNCTFLGK

181 RVEHHGTEKS DVVCSSSLPA RKPPNEPHVY LPGLIILLLF ASVALVAAII FGVCYRKKGK

241 ALTANLWHWI NEACGRLSGD KESSGDSCVS THTANFGQQG ACEGVLLLTL EEKTFPEDMC

301 YPDQGGVCQG TCVGGGPYAQ GEDARMLSLV SKTEIEEDSF RQMPTEDEYM DRPSQPTDQL

361 LFLTEPGSKS TPPFSEPLEV GENDSLSQCF TGTQSTVGSE SCNCTEPLCR TDWTPMSSEN

421 YLQKEVDSGH CPHWAASPSP NWADVCTGCR NPPGEDCEPL VGSPKRGPLP QCAYGMGLPP

481 EEEASRTEAR DQPEDGADGR LPSSARAGAG SGSSPGGQSP ASGNVTGNSN STFISSGQVM

541 NFKGDIIVVY VSQTSQEGAA AAAEPMGRPV QEETLARRDS FAGNGPRFPD PCGGPEGLRE

601 PEKASRPVQE QGGAKA.
```

In some embodiments, the non-target antigen comprises a TNFRSF11A polymorphism with an A at position 192 of SEQ ID NO: 13, and the second receptor comprises a ligand binding domain with a higher affinity for a TNFRSF11A ligand with an A at position 192 of SEQ ID NO: 13 than for a TNFRSF11A ligand with a V at position 192 of SEQ ID NO: 13. In some embodiments, the non-target antigen comprises a TNFRSF11A polymorphism with a V at position 192 of SEQ ID NO: 13, and the second receptor comprises a ligand binding domain with a higher affinity for a TNFRSF11A ligand with an V at position 192 of SEQ ID NO: 13 than for a TNFRSF11A ligand with an A at position 192 of SEQ ID NO: 13. In some embodiments, the non-target antigen comprises a TNFRSF11A polymorphism with an H at position 141 of SEQ ID NO: 13, and the second receptor comprises a ligand binding domain with a higher affinity for a TNFRSF11A ligand with an H at position 141 of SEQ ID NO: 13 than for a TNFRSF11A ligand with a Y at position 141 of SEQ ID NO: 13. In some embodiments, the non-target antigen comprises a TNFRSF11A polymorphism with a Y at position 141 of SEQ ID NO: 13, and the second receptor comprises a ligand binding domain with a higher affinity for a TNFRSF11A ligand with a Y at position 141 of SEQ ID NO: 13 than for a TNFRSF11A ligand with an H at position 141 of SEQ ID NO: 13.

Mouse TNFRSF11A isoform 1 is described in NCBI record number AH19185.1, the contents of which are incorporated by reference in their entirety. In some embodiments, TNFRSF11A comprises an amino acid sequence of:

```
                                                       (SEQ ID NO: 32)
  1 MAPRARRRRQ LPAPLLALCV LLVPLQVTLQ VTPPCTQERH YEHLGRCCSR CEPGKYLSSK

61 CTPTSDSVCL PCGPDEYLDT WNEEDKCLLH KVCDAGKALV AVDPGNHTAP RRCACTAGYH

121 WNSDCECCRR NTECAPGFGA QHPLQLNKDT VCTPCLLGFF SDVFSSTDKC KPWTNCTLLG

181 KLEAHQGTTE SDVVCSSSMT LRRPPKEAQA YLPSLIVLLL FISVVVVAAI IFGVYYRKGG

241 KALTANLWNW VNDACSSLSG NKESSGDRCA GSHSATSSQQ EVCEGILLMT REEKMVPEDG

301 AGVCGPVCAA GGPWAEVRDS RTFTLVSEVE TQGDLSRKIP TEDEYTDRPS QPSTGSLLLI

361 QQGSKSIPPF QEPLEVGEND SLSQCFTGTE STVDSEGCDF TEPPSRTDSM PVSPEKHLTK

421 EIEGDSCLPW VVSSNSTDGY TGSGNTPGED HEPFPGSLKC GPLPQCAYSM GFPSEAAASM

481 AEAGVRPQDR ADEKGASGSG SSPSDQPPAS GNVTGNSNST FISSGQVMNF KGDIIVVYVS

541 QTSQEGPGSA EPESEPVGRP VQEETLAHRD SFAGTAPRFP DVCATGAGLQ EQGAPRQKDG

601 TSRPVQEQGG AQTSLHTQGS GQCAE.
```

In some embodiments, TNFRSF11A comprises a sequence that shares at least 80%, at least 85%, at least 90%, at least 95%, at least 96%, at least 97%, at least 98%, or at least 99% identity to SEQ ID NO: 32. Polymorphic residues of TNFRSF11A are marked as bold and underlined in SEQ ID NO: 32.

In some embodiments, the non-target antigen comprises a polymorphism of TNFRSF1TA. Polymorphic residues of TNFRSF11A include 142 and 193 of SEQ ID NO: 32. In some embodiments, the non-target antigen comprises a peptide of TNFRSF11A comprising amino acid 142 or 193 of SEQ ID NO: 32.

In some embodiments, the non-target antigen comprises integrin Alpha-E (ITGAE) or an antigen peptide thereof in a complex with MHC-I. ITGAE comprises two polymorphisms in the extracellular domain: R950W (rs1716) with a minor allele frequency (MAF) of 0.2654 and V1019A/V1019G (rs2976230) with an MAF of 0.282.

Human ITGAE (R950/V10109) is described in NCBI record number NP_002199.3 the contents of which are incorporated by reference herein in their entirety. In some embodiments, ITGAE comprises an amino acid sequence of

```
                                                          (SEQ ID NO: 14)
   1 MWLFHTLLCI ASLALLAAFN VDVARPWLTP KGGAPFVLSS LLHQDPSTNQ TWLLVTSPRT

61 KRTPGPLHRC SLVQDEILCH PVEHVPIPKG RHRGVTVVRS HHGVLICIQV LVRRPHSLSS

121 ELTGTCSLLG PDLRPQAQAN FFDLENLLDP DARVDTGDCY SNKEGGGEDD VNTARQRRAL

181 EKEEEEDKEE EEDEEEEEAG TEIAIILDGS GSIDPPDFQR AKDFISNMMR NFYEKCFECN

241 FALVQYGGVI QTEFDLRDSQ DVMASLARVQ NITQVGSVTK TASAMQHVLD SIFTSSHGSR

301 RKASKVMVVL TDGGIFEDPL NLTTVINSPK MQGVERFAIG VGEEFKSART ARELNLIASD

361 PDETHAFKVT NYMALDGLLS KLRYNIISME GTVGDALHYQ LAQIGFSAQI LDERQVLLGA

421 VGAFDWSGGA LLYDTRSRRG RFLNQTAAAA ADAEAAQYSY LGYAVAVLHK TCSLSYIAGA

481 PRYKHHGAVF ELQKEGREAS FLPVLEGEQM GSYFGSELCP VDIDMDGSTD FLLVAAPFYH

541 VHGEEGRVYV YRLSEQDGSF SLARILSGHP GFTNARFGFA MAAMGDLSQD KLTDVAIGAP

601 LEGFGADDGA SFGSVYIYNG HWDGLSASPS QRIRASTVAP GLQYFGMSMA GGFDISGDGL

661 ADITVGTLGQ AVVFRSRPVV RLKVSMAFTP SALPIGFNGV VNVRLCFEIS SVTTASESGL

721 REALLNFTLD VDVGKQRRRL QCSDVRSCLG CLREWSSGSQ LCEDLLLMPT EGELCEEDCF

781 SNASVKVSYQ LQTPEGQTDH PQPILDRYTE PFAIFQLPYE KACKNKLFCV AELQLATTVS

841 QQELVVGLTK ELTLNINLTN SGEDSYMTSM ALNYPRNLQL KRMQKPPSPN IQCDDPQPVA

901 SVLIMNCRIG HPVLKRSSAH VSVVWQLEEN AFPNRTADIT VTVTNSNERR SLANETHTLQ

961 FRHGFVAVLS KPSIMYVNTG QGLSHHKEFL FHVHGENLFG AEYQLQICVP TKLRGLQVVA

1021 VKKLTRTQAS TVCTWSQERA CAYSSVQHVE EWHSVSCVIA SDKENVTVAA EISWDHSEEL

1081 LKDVTELQIL GEISFNKSLY EGLNAENHRT KITVVFLKDE KYHSLPIIIK GSVGGLLVLI

1141 VILVILFKCG FFKRKYQQLN LESIRKAQLK SENLLEEEN.
```

In some embodiments, ITGAE comprises a sequence that shares at least 80%, at least 85%, at least 90%, at least 95%, at least 96%, at least 97%, at least 98%, or at least 99% identity to SEQ ID NO: 14. Polymorphic residues of ITGAE are marked as bold and underlined in SEQ ID NO: 14.

In some embodiments, the polymorphism of ITGAE comprises an R950W/V1019 allele of ITGAE. In some embodiments, the polymorphism of ITGAE comprises a sequence of:

(polymorphic amino acids are bold and underlined)

```
                                                          (SEQ ID NO: 232)
   1 MWLFHTLLCI ASLALLAAFN VDVARPWLTP KGGAPFVLSS LLHQDPSTNQ TWLLVTSPRT

61 KRTPGPLHRC SLVQDEILCH PVEHVPIPKG RHRGVTVVRS HHGVLICIQV LVRRPHSLSS

121 ELTGTCSLLG PDLRPQAQAN FFDLENLLDP DARVDTGDCY SNKEGGGEDD VNTARQRRAL

181 EKEEEEDKEE EEDEEEEEAG TEIAIILDGS GSIDPPDFQR AKDFISNMMR NFYEKCFECN

241 FALVQYGGVI QTEFDLRDSQ DVMASLARVQ NITQVGSVTK TASAMQHVLD SIFTSSHGSR

301 RKASKVMVVL TDGGIFEDPL NLTTVINSPK MQGVERFAIG VGEEFKSART ARELNLIASD
```

```
361 PDETHAFKVT NYMALDGLLS KLRYNIISME GTVGDALHYQ LAQIGFSAQI LDERQVLLGA

421 VGAFDWSGGA LLYDTRSRRG RFLNQTAAAA ADAEAAQYSY LGYAVAVLHK TCSLSYIAGA

481 PRYKHHGAVF ELQKEGREAS FLPVLEGEQM GSYFGSELCP VDIDMDGSTD FLLVAAPFYH

541 VHGEEGRVYV YRLSEQDGSF SLARILSGHP GFTNARFGFA MAAMGDLSQD KLTDVAIGAP

601 LEGFGADDGA SFGSVYIYNG HWDGLSASPS QRIRASTVAP GLQYFGMSMA GGFDISGDGL

661 ADITVGTLGQ AVVFRSRPVV RLKVSMAFTP SALPIGFNGV VNVRLCFEIS SVTTASESGL

721 REALLNFTLD VDVGKQRRRL QCSDVRSCLG CLREWSSGSQ LCEDLLLMPT EGELCEEDCF

781 SNASVKVSYQ LQTPEGQTDH PQPILDRYTE PFAIFQLPYE KACKNKLFCV AELQLATTVS

841 QQELVVGLTK ELTLNINLTN SGEDSYMTSM ALNYPRNLQL KRMQKPPSPN IQCDDPQPVA

901 SVLIMNCRIG HPVLKRSSAH VSVVWQLEEN AFPNRTADIT VTVTNSNERW SLANETHTLQ

961 FRHGFVAVLS KPSIMYVNTG QGLSHHKEFL FHVHGENLFG AEYQLQICVP TKLRGLQVVA

1021 VKKLTRTQAS TVCTWSQERA CAYSSVQHVE EWHSVSCVIA SDKENVTVAA EISWDHSEEL

1081 LKDVTELQIL GEISFNKSLY EGLNAENHRT KITVVFLKDE KYHSLPIIIK GSVGGLLVLI

1141 VILVILFKCG FFKRKYQQLN LESIRKAQLK SENLLEEEN.
```

In some embodiments, the polymorphism of ITGAE comprises an R950/V1019A allele of ITGAE. In some embodiments, the polymorphism of ITGAE comprises a sequence of:

```
(polymorphic amino acids are bold and underlined)
                                                         (SEQ ID NO: 233)
   1 MWLFHTLLCI ASLALLAAFN VDVARPWLTP KGGAPFVLSS LLHQDPSTNQ TWLLVTSPRT

61 KRTPGPLHRC SLVQDEILCH PVEHVPIPKG RHRGVTVVRS HHGVLICIQV LVRRPHSLSS

121 ELTGTCSLLG PDLRPQAQAN FFDLENLLDP DARVDTGDCY SNKEGGGEDD VNTARQRRAL

181 EKEEEEDKEE EEDEEEEEAG TEIAIILDGS GSIDPPDFQR AKDFISNMMR NFYEKCFECN

241 FALVQYGGVI QTEFDLRDSQ DVMASLARVQ NITQVGSVTK TASAMQHVLD SIFTSSHGSR

301 RKASKVMVVL TDGGIFEDPL NLTTVINSPK MQGVERFAIG VGEEFKSART ARELNLIASD

361 PDETHAFKVT NYMALDGLLS KLRYNIISME GTVGDALHYQ LAQIGFSAQI LDERQVLLGA

421 VGAFDWSGGA LLYDTRSRRG RFLNQTAAAA ADAEAAQYSY LGYAVAVLHK TCSLSYIAGA

481 PRYKHHGAVF ELQKEGREAS FLPVLEGEQM GSYFGSELCP VDIDMDGSTD FLLVAAPFYH

541 VHGEEGRVYV YRLSEQDGSF SLARILSGHP GFTNARFGFA MAAMGDLSQD KLTDVAIGAP

601 LEGFGADDGA SFGSVYIYNG HWDGLSASPS QRIRASTVAP GLQYFGMSMA GGFDISGDGL

661 ADITVGTLGQ AVVFRSRPVV RLKVSMAFTP SALPIGFNGV VNVRLCFEIS SVTTASESGL

721 REALLNFTLD VDVGKQRRRL QCSDVRSCLG CLREWSSGSQ LCEDLLLMPT EGELCEEDCF

781 SNASVKVSYQ LQTPEGQTDH PQPILDRYTE PFAIFQLPYE KACKNKLFCV AELQLATTVS

841 QQELVVGLTK ELTLNINLTN SGEDSYMTSM ALNYPRNLQL KRMQKPPSPN IQCDDPQPVA

901 SVLIMNCRIG HPVLKRSSAH VSVVWQLEEN AFPNRTADIT VTVTNSNERR SLANETHTLQ

961 FRHGFVAVLS KPSIMYVNTG QGLSHHKEFL FHVHGENLFG AEYQLQICVP TKLRGLQVAA

1021 VKKLTRTQAS TVCTWSQERA CAYSSVQHVE EWHSVSCVIA SDKENVTVAA EISWDHSEEL

1081 LKDVTELQIL GEISFNKSLY EGLNAENHRT KITVVFLKDE KYHSLPIIIK GSVGGLLVLI

1141 VILVILFKCG FFKRKYQQLN LESIRKAQLK SENLLEEEN.
```

In some embodiments, the polymorphism of ITGAE comprises an R950/V1019G allele of ITGAE. In some embodiments, the polymorphism of ITGAE comprises a sequence of:

```
(polymorphic amino acids are bold and underlined)
                                                       (SEQ ID NO: 234)
   1 MWLFHTLLCI ASLALLAAFN VDVARPWLTP KGGAPFVLSS LLHQDPSTNQ TWLLVTSPRT

61 KRTPGPLHRC SLVQDEILCH PVEHVPIPKG RHRGVTVVRS HHGVLICIQV LVRRPHSLSS

121 ELTGTCSLLG PDLRPQAQAN FFDLENLLDP DARVDTGDCY SNKEGGGEDD VNTARQRRAL

181 EKEEEEDKEE EEDEEEEEAG TEIAIILDGS GSIDPPDFQR AKDFISNMMR NFYEKCFECN

241 FALVQYGGVI QTEFDLRDSQ DVMASLARVQ NITQVGSVTK TASAMQHVLD SIFTSSHGSR

301 RKASKVMVVL TDGGIFEDPL NLTTVINSPK MQGVERFAIG VGEEFKSART ARELNLIASD

361 PDETHAFKVT NYMALDGLLS KLRYNIISME GTVGDALHYQ LAQIGFSAQI LDERQVLLGA

421 VGAFDWSGGA LLYDTRSRRG RFLNQTAAAA ADAEAAQYSY LGYAVAVLHK TCSLSYIAGA

481 PRYKHHGAVF ELQKEGREAS FLPVLEGEQM GSYFGSELCP VDIDMDGSTD FLLVAAPFYH

541 VHGEEGRVYV YRLSEQDGSF SLARILSGHP GFTNARFGFA MAAMGDLSQD KLTDVAIGAP

601 LEGFGADDGA SFGSVYIYNG HWDGLSASPS QRIRASTVAP GLQYFGMSMA GGFDISGDGL

661 ADITVGTLGQ AVVFRSRPVV RLKVSMAFTP SALPIGFNGV VNVRLCFEIS SVTTASESGL

721 REALLNFTLD VDVGKQRRRL QCSDVRSCLG CLREWSSGSQ LCEDLLLMPT EGELCEEDCF

781 SNASVKVSYQ LQTPEGQTDH PQPILDRYTE PFAIFQLPYE KACKNKLFCV AELQLATTVS

841 QQELVVGLTK ELTLNINLTN SGEDSYMTSM ALNYPRNLQL KRMQKPPSPN IQCDDPQPVA

901 SVLIMNCRIG HPVLKRSSAH VSVVWQLEEN AFPNRTADIT VTVTNSNERR SLANETHTLQ

961 FRHGFVAVLS KPSIMYVNTG QGLSHHKEFL FHVHGENLFG AEYQLQICVP TKLRGLQVGA

1021 VKKLTRTQAS TVCTWSQERA CAYSSVQHVE EWHSVSCVIA SDKENVTVAA EISWDHSEEL

1081 LKDVTELQIL GEISFNKSLY EGLNAENHRT KITVVFLKDE KYHSLPIIIK GSVGGLLVLI

1141 VILVILFKCG FFKRKYQQLN LESIRKAQLK SENLLEEEN.
```

In some embodiments, the polymorphism of ITGAE comprises an R950W/V1019 allele of ITGAE. In some embodiments, the polymorphism of ITGAE comprises a sequence of:

```
(polymorphic amino acids are bold and underlined)
                                                       (SEQ ID NO: 235)
   1 MWLFHTLLCI ASLALLAAFN VDVARPWLTP KGGAPFVLSS LLHQDPSTNQ TWLLVTSPRT

61 KRTPGPLHRC SLVQDEILCH PVEHVPIPKG RHRGVTVVRS HHGVLICIQV LVRRPHSLSS

121 ELTGTCSLLG PDLRPQAQAN FFDLENLLDP DARVDTGDCY SNKEGGGEDD VNTARQRRAL

181 EKEEEEDKEE EEDEEEEEAG TEIAIILDGS GSIDPPDFQR AKDFISNMMR NFYEKCFECN

241 FALVQYGGVI QTEFDLRDSQ DVMASLARVQ NITQVGSVTK TASAMQHVLD SIFTSSHGSR

301 RKASKVMVVL TDGGIFEDPL NLTTVINSPK MQGVERFAIG VGEEFKSART ARELNLIASD

361 PDETHAFKVT NYMALDGLLS KLRYNIISME GTVGDALHYQ LAQIGFSAQI LDERQVLLGA

421 VGAFDWSGGA LLYDTRSRRG RFLNQTAAAA ADAEAAQYSY LGYAVAVLHK TCSLSYIAGA

481 PRYKHHGAVF ELQKEGREAS FLPVLEGEQM GSYFGSELCP VDIDMDGSTD FLLVAAPFYH

541 VHGEEGRVYV YRLSEQDGSF SLARILSGHP GFTNARFGFA MAAMGDLSQD KLTDVAIGAP

601 LEGFGADDGA SFGSVYIYNG HWDGLSASPS QRIRASTVAP GLQYFGMSMA GGFDISGDGL

661 ADITVGTLGQ AVVFRSRPVV RLKVSMAFTP SALPIGFNGV VNVRLCFEIS SVTTASESGL
```

```
 721  REALLNFTLD  VDVGKQRRRL  QCSDVRSCLG  CLREWSSGSQ  LCEDLLLMPT  EGELCEEDCF

781  SNASVKVSYQ  LQTPEGQTDH  PQPILDRYTE  PFAIFQLPYE  KACKNKLFCV  AELQLATTVS

841  QQELVVGLTK  ELTLNINLTN  SGEDSYMTSM  ALNYPRNLQL  KRMQKPPSPN  IQCDDPQPVA

901  SVLIMNCRIG  HPVLKRSSAH  VSVVWQLEEN  AFPNRTADIT  VTVTNSNERW  SLANETHTLQ

961  FRHGFVAVLS  KPSIMYVNTG  QGLSHHKEFL  FHVHGENLFG  AEYQLQICVP  TKLRGLQVVA

1021  VKKLTRTQAS  TVCTWSQERA  CAYSSVQHVE  EWHSVSCVIA  SDKENVTVAA  EISWDHSEEL

1081  LKDVTELQIL  GEISFNKSLY  EGLNAENHRT  KITVVFLKDE  KYHSLPIIIK  GSVGGLLVLI

1141  VILVILFKCG  FFKRKYQQLN  LESIRKAQLK  SENLLEEEN.
```

In some embodiments, the polymorphism of ITGAE comprises an R950W/V1019A allele of ITGAE. In some embodiments, the polymorphism of ITGAE comprises a sequence of:

```
(polymorphic amino acids are bold and underlined)
                                                             (SEQ ID NO: 236)
   1  MWLFHTLLCI  ASLALLAAFN  VDVARPWLTP  KGGAPFVLSS  LLHQDPSTNQ  TWLLVTSPRT

61  KRTPGPLHRC  SLVQDEILCH  PVEHVPIPKG  RHRGVTVVRS  HHGVLICIQV  LVRRPHSLSS

121  ELTGTCSLLG  PDLRPQAQAN  FFDLENLLDP  DARVDTGDCY  SNKEGGGEDD  VNTARQRRAL

181  EKEEEEDKEE  EEDEEEEEAG  TEIAIILDGS  GSIDPPDFQR  AKDFISNMMR  NFYEKCFECN

241  FALVQYGGVI  QTEFDLRDSQ  DVMASLARVQ  NITQVGSVTK  TASAMQHVLD  SIFTSSHGSR

301  RKASKVMVVL  TDGGIFEDPL  NLTTVINSPK  MQGVERFAIG  VGEEFKSART  ARELNLIASD

361  PDETHAFKVT  NYMALDGLLS  KLRYNIISME  GTVGDALHYQ  LAQIGFSAQI  LDERQVLLGA

421  VGAFDWSGGA  LLYDTRSRRG  RFLNQTAAAA  ADAEAAQYSY  LGYAVAVLHK  TCSLSYIAGA

481  PRYKHHGAVF  ELQKEGREAS  FLPVLEGEQM  GSYFGSELCP  VDIDMDGSTD  FLLVAAPFYH

541  VHGEEGRVYV  YRLSEQDGSF  SLARILSGHP  GFTNARFGFA  MAAMGDLSQD  KLTDVAIGAP

601  LEGFGADDGA  SFGSVYIYNG  HWDGLSASPS  QRIRASTVAP  GLQYFGMSMA  GGFDISGDGL

661  ADITVGTLGQ  AVVFRSRPVV  RLKVSMAFTP  SALPIGFNGV  VNVRLCFEIS  SVTTASESGL

721  REALLNFTLD  VDVGKQRRRL  QCSDVRSCLG  CLREWSSGSQ  LCEDLLLMPT  EGELCEEDCF

781  SNASVKVSYQ  LQTPEGQTDH  PQPILDRYTE  PFAIFQLPYE  KACKNKLFCV  AELQLATTVS

841  QQELVVGLTK  ELTLNINLTN  SGEDSYMTSM  ALNYPRNLQL  KRMQKPPSPN  IQCDDPQPVA

901  SVLIMNCRIG  HPVLKRSSAH  VSVVWQLEEN  AFPNRTADIT  VTVTNSNERW  SLANETHTLQ

961  FRHGFVAVLS  KPSIMYVNTG  QGLSHHKEFL  FHVHGENLFG  AEYQLQICVP  TKLRGLQVAA

1021  VKKLTRTQAS  TVCTWSQERA  CAYSSVQHVE  EWHSVSCVIA  SDKENVTVAA  EISWDHSEEL

1081  LKDVTELQIL  GEISFNKSLY  EGLNAENHRT  KITVVFLKDE  KYHSLPIIIK  GSVGGLLVLI

1141  VILVILFKCG  FFKRKYQQLN  LESIRKAQLK  SENLLEEEN.
```

In some embodiments, the polymorphism of ITGAE comprises an R950W/V1019G allele of ITGAE. In some embodiments, the polymorphism of ITGAE comprises a sequence of:

```
(polymorphic amino acids are bold and underlined)
                                                             (SEQ ID NO: 237)
   1  MWLFHTLLCI  ASLALLAAFN  VDVARPWLTP  KGGAPFVLSS  LLHQDPSTNQ  TWLLVTSPRT

61  KRTPGPLHRC  SLVQDEILCH  PVEHVPIPKG  RHRGVTVVRS  HHGVLICIQV  LVRRPHSLSS

121  ELTGTCSLLG  PDLRPQAQAN  FFDLENLLDP  DARVDTGDCY  SNKEGGGEDD  VNTARQRRAL
```

-continued

181 EKEEEEDKEE EEDEEEEEAG TEIAIILDGS GSIDPPDFQR AKDFISNMMR NFYEKCFECN

241 FALVQYGGVI QTEFDLRDSQ DVMASLARVQ NITQVGSVTK TASAMQHVLD SIFTSSHGSR

301 RKASKVMVVL TDGGIFEDPL NLTTVINSPK MQGVERFAIG VGEEFKSART ARELNLIASD

361 PDETHAFKVT NYMALDGLLS KLRYNIISME GTVGDALHYQ LAQIGFSAQI LDERQVLLGA

421 VGAFDWSGGA LLYDTRSRRG RFLNQTAAAA ADAEAAQYSY LGYAVAVLHK TCSLSYIAGA

481 PRYKHHGAVF ELQKEGREAS FLPVLEGEQM GSYFGSELCP VDIDMDGSTD FLLVAAPFYH

541 VHGEEGRVYV YRLSEQDGSF SLARILSGHP GFTNARFGFA MAAMGDLSQD KLTDVAIGAP

601 LEGFGADDGA SFGSVYIYNG HWDGLSASPS QRIRASTVAP GLQYFGMSMA GGFDISGDGL

661 ADITVGTLGQ AVVFRSRPVV RLKVSMAFTP SALPIGFNGV VNVRLCFEIS SVTTASESGL

721 REALLNFTLD VDVGKQRRRL QCSDVRSCLG CLREWSSGSQ LCEDLLLMPT EGELCEEDCF

781 SNASVKVSYQ LQTPEGQTDH PQPILDRYTE PFAIFQLPYE KACKNKLFCV AELQLATTVS

841 QQELVVGLTK ELTLNINLTN SGEDSYMTSM ALNYPRNLQL KRMQKPPSPN IQCDDPQPVA

901 SVLIMNCRIG HPVLKRSSAH VSVVWQLEEN AFPNRTADIT VTVTNSNERW SLANETHTLQ

961 FRHGFVAVLS KPSIMYVNTG QGLSHHKEFL FHVHGENLFG AEYQLQICVP TKLRGLQVGA

1021 VKKLTRTQAS TVCTWSQERA CAYSSVQHVE EWHSVSCVIA SDKENVTVAA EISWDHSEEL

1081 LKDVTELQIL GEISFNKSLY EGLNAENHRT KITVVFLKDE KYHSLPIIIK GSVGGLLVLI

1141 VILVILFKCG FFKRKYQQLN LESIRKAQLK SENLLEEEN.

In some embodiments, the non-target antigen comprises a polymorphism of ITGAE. For example, the non-target antigen comprises a peptide derived from ITGAE comprising a polymorphic residue of ITGAE. Polymorphic residues of ITGAE include amino acids 950 and 1019 of SEQ ID NO: 14. In some embodiments, the non-target antigen comprises a peptide of ITGAE comprising amino acid 950 or 1019 of SEQ ID NO: 14.

In some embodiments, the non-target antigen comprises a ITGAE polymorphism with a R at position 950 of SEQ ID NO: 14, and the second receptor comprises a ligand binding domain with a higher affinity for an ITGAE ligand with an R at position 950 of SEQ ID NO: 14 than for an ITGAE ligand with a W at position 950 of SEQ ID NO: 14. In some embodiments, the non-target antigen comprises a ITGAE polymorphism with a W at position 950 of SEQ ID NO: 14, and the second receptor comprises a ligand binding domain with a higher affinity for an ITGAE ligand with an W at position 950 of SEQ ID NO: 14 than for an ITGAE ligand with an R at position 950 of SEQ ID NO: 14. In some embodiments, the non-target antigen comprises a ITGAE polymorphism with a V at position 1019 of SEQ ID NO: 14, and the second receptor comprises a ligand binding domain with a higher affinity for an ITGAE ligand with a V at position 1019 of SEQ ID NO: 14 than for an ITGAE ligand with an A or G at position 1019 of SEQ ID NO: 14. In some embodiments, the non-target antigen comprises a ITGAE polymorphism with an A at position 1019 of SEQ ID NO: 14, and the second receptor comprises a ligand binding domain with a higher affinity for an ITGAE ligand with an A at position 1019 of SEQ ID NO: 14 than for an ITGAE ligand with a V or G at position 1019 of SEQ ID NO: 14. In some embodiments, the non-target antigen comprises an ITGAE polymorphism with a G at position 1019 of SEQ ID NO: 14, and the second receptor comprises a ligand binding domain with a higher affinity for an ITGAE ligand with a G at position 1019 of SEQ ID NO: 14 than for an ITGAE ligand with a V or A at position 1019 of SEQ ID NO: 14.

In some embodiments, the non-target antigen comprises ACHRB (also called CHRNB, or CHRNB1) or an antigen peptide thereof in a complex with MHC-I. Human ACHRB is described in NCBI record number NP_000738.2 the contents of which are incorporated by reference herein in their entirety. In some embodiments, ACHRB comprises an amino acid sequence of:

(SEQ ID NO: 33)

1 MTPGALLMLL GALGAPLAPG VRGSEAEGRL REKLFSGYDS SVRPAREVGD RVRVSVGLIL

61 AQLISLNEKD EEMSTKVYLD LEWTDYRLSW DPAEHDGIDS LRITAESVWL PDVVLLNNND

121 GNFDVALDIS VVVSSDGSVR WQPPGIYRSS CSIQVTYFPF DWQNCTMVFS SYSYDSSEVS

181 LQTGLGPDGQ GHQEIHIHEG TFIENGQWEI IHKPSRLIQP PGDPRGGREG QRQEVIFYLI

241 IRRKPLFYLV NVIAPCILIT LLAIFVFYLP PDAGEKMGLS IFALLTLTVF LLLLADKVPE

301 TSLSVPIIIK YLMFTMVLVT FSVILSVVVL NLHHRSPHTH QMPLWVRQIF IHKLPLYLRL

361 KRPKPERDLM PEPPHCSSPG SGWGRGTDEY FIRKPPSDFL FPKPNRFQPE LSAPDLRRFI

421 DGPNRAVALL PELREVVSSI SYIARQLQEQ EDHDALKEDW QFVAMVVDRL FLWTFIIFTS

481 VGTLVIFLDA TYHLPPPDPF P.

In some embodiments, ACHRB comprises a sequence that shares at least 80%, at least 85%, at least 90%, at least 95%, at least 96%, at least 97%, at least 98%, or at least 99% identity to SEQ ID NO: 33. Polymorphic residues of ACHRB are marked as bold and underlined in SEQ ID NO: 33.

In some embodiments, the non-target antigen comprises a polymorphism of ACHRB. For example, the non-target antigen comprises a peptide derived from ACHRB comprising a polymorphic residue of ACHRB. Polymorphic residues of ACHRB include 32 of SEQ ID NO: 33. In some embodiments, the non-target antigen comprises a peptide of ACHRB comprising amino acid 32 of SEQ ID NO: 33. In some embodiments, the non-target antigen comprises a peptide of ACHRB comprising an E at amino acid 32 of SEQ ID NO: 33. In some embodiments, the non-target antigen comprises a peptide of ACHRB comprising a G at amino acid 32 of SEQ ID NO: 33.

In some embodiments, the non-target antigen comprises TRPV1 or an antigen peptide thereof in a complex with MHC-I. Human TRPV1 is described in NCBI record number NP_542435.2, the contents of which are incorporated by reference herein in their entirety. In some embodiments, TRPV1 comprises an amino acid sequence of:

(SEQ ID NO: 34)
```
  1   MKKWSSTDLG AAADPLQKDT CPDPLDGDPN SRPPPAKPQL STAKSRTRLF GKGDSEEAFP
 61   VDCPHEEGEL DSCPTITVSP VITIQRPGDG PTGARLLSQD SVAASTEKTL RLYDRRSIFE
121   AVAQNNCQDL ESLLLFLQKS KKHLTDNEFK DPETGKTCLL KAMLNLHDGQ NTTIPLLLEI
181   ARQTDSLKEL VNASYTDSYY KGQTALHIAI ERRNMALVTL LVENGADVQA AAHGDFFKKT
241   KGRPGFYFGE LPLSLAACTN QLGIVKFLLQ NSWQTADISA RDSVGNTVLH ALVEVADNTA
301   DNTKFVTSMY NEILMLGAKL HPTLKLEELT NKKGMTPLAL AAGTGKIGVL AYILQREIQE
361   PECRHLSRKF TEWAYGPVHS SLYDLSCIDT CEKNSVLEVI AYSSSETPNR HDMLLVEPLN
421   RLLQDKWDRF VKRIFYFNFL VYCLYMIIFT MAAYYRPVDG LPPFKMEKTG DYFRVTGEIL
481   SVLGGVYFFF RGIQYFLQRR PSMKTLFVDS YSEMLFFLQS LFMLATVVLY FSHLKEYVAS
541   MVFSLALGWT NMLYYTRGFQ QMGIYAVMIE KMILRDLCRF MFVYIVFLFG FSTAVVTLIE
601   DGKNDSLPSE STSHRWRGPA CRPPDSSYNS LYSTCLELFK FTIGMGDLEF TENYDFKAVF
661   IILLLAYVIL TYILLLNMLI ALMGETVNKI AQESKNIWKL QRAITILDTE KSFLKCMRKA
721   FRSGKLLQVG YTPDGKDDYR WCFRVDEVNW TTWNTNVGII NEDPGNCEGV KRTLSFSLRS
781   SRVSGRHWKN FALVPLLREA SARDRQSAQP EEVYLRQFSG SLKPEDAEVF KSPAASGEK.
```

In some embodiments, TRPV1 comprises a sequence that shares at least 80%, at least 85%, at least 90%, at least 95%, at least 94%, at least 97%, at least 98%, or at least 99% identity to SEQ ID NO: 34. Polymorphic residues of TRPV1 are marked as bold and underlined in SEQ ID NO: 34.

In some embodiments, the non-target antigen comprises a polymorphism of TRPV1. For example, the non-target antigen comprises a peptide derived from TRPV1 comprising a polymorphic residue of TRPV1. Polymorphic residues of TRPV1 include positions 585, 459 and 469 of SEQ ID NO: 34. In some embodiments, the non-target antigen comprises a peptide of TRPV1 comprising amino acid 585, 459 or 469 of SEQ ID NO: 34. In some embodiments, the non-target antigen comprises a peptide of TRPV1 comprising an I at amino acid 585 of SEQ ID NO: 34. In some embodiments, the non-target antigen comprises a peptide of TRPV1 comprising a V at amino acid 585 of SEQ ID NO: 34.

In some embodiments, the non-target antigen comprises SREC or an antigen peptide thereof in a complex with MHC-I. Human SREC isoform 1 is described in NCBI record number NP_003684.2, the contents of which are incorporated by reference herein in their entirety. In some embodiments, SREC comprises an amino acid sequence of:

(SEQ ID NO: 35)
```
 1   MGLGLLLPLL LLWTRGTQGS ELDPKGQHVC VASSPSAELQ CCAGWRQKDQ ECTIPICEGP
61   DACQKDEVCV KPGLCRCKPG FFGAHCSSRC PGQYWGPDCR ESCPCHPHGQ CEPATGACQC
```

```
                            -continued
121    QADRWGARCE  FPCACGPHGR  CDPATGVCHC  EPGWWSSTCR  RPCQCNTAAA  RCEQATGACV

181    CKPGWWGRRC  SFRCNCHGSP  CEQDSGRCAC  RPGWWGPECQ  QQCECVRGRC  SAASGECTCP

241    PGFRGARCEL  PCPAGSHGVQ  CAHSCGRCKH  NEPCSPDTGS  CESCEPGWNG  TQCQQPCLPG

301    TFGESCEQQC  PHCRHGEACE  PDTGHCQRCD  PGWLGPRCED  PCPTGTFGED  CGSTCPTCVQ

361    GSCDTVTGDC  VCSAGYWGPS  CNASCPAGFH  GNNCSVPCEC  PEGLCHPVSG  SCQPGSGSRD

421    TALIAGSLVP  LLLLFLGLAC  CACCCWAPRS  DLKDRPARDG  ATVSRMKLQV  WGTLTSLGST

481    LPCRSLSSHK  LPWVTVSHHD  PEVPFNHSFI  EPPSAGWATD  DSFSSDPESG  EADEVPAYCV

541    PPQEGMVPVA  QAGSSEASLA  AGAFPPPEDA  STPFAIPRTS  SLARAKRPSV  SFAEGTKFAP

601    QSRRSSGELS  SPLRKPKRLS  RGAQSGPEGR  EAEESTGPEE  AEAPESFPAA  ASPGDSATGH

661    RRPPLGGRTV  AEHVEAIEGS  VQESSGPVTT  IYMLAGKPRG  SEGPVRSVFR  HFGSFQKGQA

721    EAKVKRAIPK  PPRQALNRKK  GSPGLASGSV  GQSPNSAPKA  GLPGATGPMA  VRPEEAVRGL

781    GAGTESSRRA  QEPVSGCGSP  EQDPQKQAEE  ERQEEPEYEN  VVPISRPPEP.
```

In some embodiments, SREC comprises a sequence that shares at least 80%, at least 85%, at least 90%, at least 95%, at least 94%, at least 97%, at least 98%, or at least 99% identity to SEQ ID NO: 35. Polymorphic residues of SREC are marked as bold and underlined in SEQ ID NO: 35.

In some embodiments, the non-target antigen comprises a polymorphism of SREC. For example, the non-target antigen comprises a peptide derived from SREC comprising a polymorphic residue of SREC. Polymorphic residues of SREC include positions 339 and 425 of SEQ ID NO: 35. In some embodiments, the non-target antigen comprises a peptide of SREC comprising amino acid 339 or 425 of SEQ ID NO: 35. In some embodiments, the non-target antigen comprises a peptide of SREC comprising an A at amino acid 425 of SEQ ID NO: 35. In some embodiments, the non-target antigen comprises a peptide of SREC comprising a V at amino acid 425 of SEQ ID NO: 35.

In some embodiments, the non-target antigen comprises C—X—C motif chemokine ligand 16 (CXCL16) or an antigen peptide thereof in a complex with MHC-I. Human CXCL16 precursor is described in NCBI record number NP_001094282.1, the contents of which are incorporated by reference herein in their entirety. In some embodiments, CXCL16 comprises an amino acid sequence of:

```
                                                                    (SEQ ID NO: 136)
1      MSGSQSEVAP  SPQSPRSPEM  GRDLRPGSRV  LLLLLLLLLV  YLTQPGNGNE  GSVTGSCYCG

61     KRISSDSPPS  VQFMNRLRKH  LRAYHRCLYY  TRFQLLSWSV  CGGNKDPWVQ  ELMSCLDLKE

121    CGHAYSGIVA  HQKHLLPTSP  PISQASEGAS  SDIHTPAQML  LSTLQSTQRP  TLPVGSLSSD

181    KELTRPNETT  IHTAGHSLAA  GPEAGENQKQ  PEKNAGPTAR  TSATVPVLCL  LAIIFILTAA

241    LSYVLCKRRR  GQSPQSSPDL  PVHYIPVAPD  SNT.
```

In some embodiments, the non-target antigen comprises a polymorphism of CXCL16. For example, the non-target antigen comprises a peptide derived from CXCL16 comprising a polymorphic residue of CXCL16. Polymorphic residues of CXCL16 include positions 142 and 200 of SEQ ID NO: 136. In some embodiments, the non-target antigen comprises a peptide of CXCL16 comprising amino acid 142 or 200 of SEQ ID NO: 136. In some embodiments, the non-target antigen comprises a peptide of CXCL16 comprising an A at amino acid 200 of SEQ ID NO: 136. In some embodiments, the non-target antigen comprises a peptide of CXCL16 comprising a V at amino acid 200 of SEQ ID NO: 136. In some embodiments, the non-target antigen comprises a peptide of CXCL16 comprising an I at amino acid 142 of SEQ ID NO: 136. In some embodiments, the non-target antigen comprises a peptide of CXCL16 comprising a T at amino acid 142 of SEQ ID NO: 136.

In some embodiments, the non-target antigen comprises collectin subfamily member 12 (COLEC12) or an antigen peptide thereof in a complex with MHC-I. Human COLEC12 is described in NCBI record number NP_569057.2, the contents of which are incorporated by reference herein in their entirety. In some embodiments, COLEC12 comprises an amino acid sequence of:

```
                                                            (SEQ ID NO: 137)
  1    MKDDFAEEEE VQSFGYKRFG IQEGTQCTKC KNNWALKFSI ILLYILCALL TITVAILGYK

61    VVEKMDNVTG GMETSRQTYD DKLTAVESDL KKLGDQTGKK AISTNSELST FRSDILDLRQ

121    QLREITEKTS KNKDTLEKLQ ASGDALVDRQ SQLKETLENN SFLITTVNKT LQAYNGYVTN

181    LQQDTSVLQG NLQNQMYSHN VVIMNLNNLN LTQVQQRNLI TNLQRSVDDT SQAIQRIKND

241    FQNLQQVFLQ AKKDTDWLKE KVQSLQTLAA NNSALAKANN DTLEDMNSQL NSFTGQMENI

301    TTISQANEQN LKDLQDLHKD AENRTAIKFN QLEERFQLFE TDIVNIISNI SYTAHHLRTL

361    TSNLNEVRTT CTDTLTKHTD DLTSLNNTLA NIRLDSVSLR MQQDLMRSRL DTEVANLSVI

421    MEEMKLVDSK HGQLIKNFTI LQGPPGPRGP RGDRGSQGPP GPTGNKGQKG EKGEPGPPGP

481    AGERGPIGPA GPPGERGGKG SKGSQGPKGS RGSPGKPGPQ GSSGDPGPPG PPGKEGLPGP

541    QGPPGFQGLQ GTVGEPGVPG PRGLPGLPGV PGMPGPKGPP GPPGPSGAVV PLALQNEPTP

601    APEDNGCPPH WKNFTDKCYY FSVEKEIFED AKLFCEDKSS HLVFINTREE QQWIKKQMVG

661    RESHWIGLTD SERENEWKWL DGTSPDYKNW KAGQPDNWGH GHGPGEDCAG LIYAGQWNDF

721    QCEDVNNFIC EKDRETVLSS AL.
```

In some embodiments, COLEC12 comprises a sequence that shares at least 80%, at least 85%, at least 90%, at least 95%, at least 94%, at least 97%, at least 98%, or at least 99% identity to SEQ ID NO: 137. Polymorphic residues of COLEC12 are marked as bold and underlined in SEQ ID NO: 137.

In some embodiments, the non-target antigen comprises a polymorphism of COLEC12. For example, the non-target antigen comprises a peptide derived from COLEC12 comprising a polymorphic residue of COLEC12. Polymorphic residues of COLEC12 include position 522 of SEQ ID NO: 137. In some embodiments, the non-target antigen comprises a peptide of COLEC12 comprising amino acid 522 of SEQ ID NO: 137. In some embodiments, the non-target antigen comprises a peptide of COLEC12 comprising an S at amino acid 522 of SEQ ID NO: 137. In some embodiments, the non-target antigen comprises a peptide of COLEC12 comprising a P at amino acid 522 of SEQ ID NO: 137.

In some embodiments, the non-target antigen comprises APC down-regulated 1 (APCDD1) or an antigen peptide thereof in a complex with MHC-I. An exemplary human APCDD1 is described in UniProtKB record number Q8J025, the contents of which are incorporated by reference herein in their entirety. In some embodiments, APCDD1 comprises an amino acid sequence of:

```
                                                            (SEQ ID NO: 138)
  1    MSWPRRLLLR YLFPALLLHG LGEGSALLHP DSRSHPRSLE KSAWRAFKES QCHHMLKHLH

61    NGARITVQMP PTIEGHWVST GCEVRSGPEF ITRSYRFYHN NTFKAYQFYY GSNRCTNPTY

121    TLIIRGKIRL RQASWIIRGG TEADYQLHNV QVICHTEAVA EKLGQQVNRT CPGFLADGGP

181    WVQDVAYDLW REENGCECTK AVNFAMHELQ LIRVEKQYLH HNLDHLVEEL FLGDIHTDAT

241    QRMFYRPSSY QPPLQNAKNH DHACIACRII YRSDEHHPPI LPPKADLTIG LHGEWVSQRC

301    EVRPEVLFLT RHFIFHDNNN TWEGHYYHYS DPVCKHPTFS IYARGRYSRG VLSSRVMGGT

361    EFVFKVNHMK VTPMDAATAS LLNVFNGNEC GAEGSWQVGI QQDVTHTNGC VALGIKLPHT

421    EYEIFKMEQD ARGRYLLFNG QRPSDGSSPD RPEKRATSYQ MPLVQCASSS PRAEDLAEDS

481    GSSLYGRAPG RHTWSLLLAA LACLVPLLHW NIRR.
```

In some embodiments, the non-target antigen comprises a polymorphism of APCDD1. Exemplary polymorphisms of APCDD1 include rs3748415, which can be a V, I or L at position 150 of SEQ ID NO: 138. In some embodiments, the non-target antigen comprises a peptide of APCDD1 comprising amino acid 150 of SEQ ID NO: 138. In some embodiments, the non-target antigen comprises a peptide of APCDD1 comprising an V at amino acid 150 of SEQ ID NO: 138. In some embodiments, the non-target antigen comprises a peptide of APCDD1 comprising an I at amino acid 150 of SEQ ID NO: 138. In some embodiments, the non-target antigen comprises a peptide of APCDD1 comprising an L at amino acid 150 of SEQ ID NO: 138.

A further exemplary human APCDD1 is described in UniProtKB record number V9GY82, the contents of which are incorporated by reference herein in their entirety. In some embodiments, APCDD1 comprises an amino acid sequence of:

(SEQ ID NO: 139)

```
  1  XDVAYDLWRE ENGCECTKAV NFAMHELQLI RVEKQYLHHN LDHLVEELFL GDIHTDATQR
 61  MFYRPSSYQP PLQNAKCAAE SSGSFQILPQ DSSEKEQNGL SHWCLSRPGH QKDWALCAHA
121  GPATAGCPSC LWPPAETGRK AGRTSSKTVH ACPGEAGTSS FELFYFPNCW SIETKLKISL
181  NAKLSFKPRA SAPLETGHRV KIETLSQLVF LSFIQLCCEV QSPLANK.
```

Exemplary polymorphisms of APCDD1 include rs1786683, which can be a Y or S at position 165 of SEQ ID NO: 139. In some embodiments, the non-target antigen comprises a peptide of APCDD1 comprising amino acid 165 of SEQ ID NO: 139. In some embodiments, the non-target antigen comprises a peptide of APCDD1 comprising a Y at amino acid 165 of SEQ ID NO: 139. In some embodiments, the non-target antigen comprises a peptide of APCDD1 comprising an S at amino acid 165 of SEQ ID NO: 139.

A further exemplary human APCDD1 is described in UniProt record number J3QSE3, the contents of which are incorporated by reference herein in their entirety. In some embodiments, APCDD1 comprises an amino acid sequence of:

(SEQ ID NO: 140)

```
  1  PEDVLPALQL PAPSAECQVE MGFHHVGQDG LQLPTSSDPP ALASQSAGIT GVSHRPPGRH
 61  LSNDLRTTTM PASPVGSSIG QTSTTLPSCP QRQT.
```

Exemplary polymorphisms of APCDD1 include rs9952598, which can be a Q or R at position 28 of SEQ ID NO: 140. In some embodiments, the non-target antigen comprises a peptide of APCDD1 comprising amino acid 28 of SEQ ID NO: 140. In some embodiments, the non-target antigen comprises a peptide of APCDD1 comprising a Q at amino acid 28 of SEQ ID NO: 140. In some embodiments, the non-target antigen comprises a peptide of APCDD1 comprising an R at amino acid 28 of SEQ ID NO: 140.

In some embodiments, APCDD1 comprises a sequence that shares at least 80%, at least 85%, at least 90%, at least 95%, at least 94%, at least 97%, at least 98%, or at least 99% identity to any one of SEQ ID NOs: 138-140. Polymorphic residues of APCDD1 are marked as bold and underlined in SEQ ID NOs: 138-140.

In some embodiments, the non-target antigen comprises HLA-A*01, HLA-A*02, HLA-A*03, HLA-A*11, HLA-1B*07 or HLA-C*07. Various single variable domains that bind to or recognize the specified HLA alleles, for use in embodiments described herein, are described in Table 5. Such scFvs include, for example and without limitation, the following mouse and humanized scFv antibodies that bind HLA alleles in a peptide-independent way shown in Table 5 below (complementarity determining regions underlined):

TABLE 5

| HLA scFv binding domains | |
|---|---|
| HLA-A*02 antigen binding domains | |
| (mouse): DVLMTQTPLSLPVS LGDQASISCRSSQSI | (mouse): GATGTTCTGATGACCCAAACTCCACTCTCCCTGCCTGTCAG TCTTGGAGATCAAGCCTCCATCTCTTGCAGATCTAGTCAG |

TABLE 5-continued

HLA scFv binding domains

| | |
|---|---|
| VHSNGNTYLEWYL QKPGQSPKLLIYKVS NRFSGVPDRFSGSGS GTDFTLKISRVEAED LGVYYCFQGSHVPR TSGGGTKLEIKGGG GSGGGGSGGGGSG GQVQLQQSGPELVK PGASVRISCKASGYT FTSYHIHWVKQRPG QGLEWIGWIYPGNV NTEYNEKFKGKATL TADKSSS

TABLE 5-continued

| HLA scFv binding domains | |
|---|---|
| TYYCFQGSHVPRTF<br>GGGTKVEIK<br>(SEQ ID NO: 94) | ACCCTCACGATCTCCTCTCTCCAGCCAGAAGATTTCGCCA<br>CTTATTACTGTTTTCAAGGTTCACATGTGCCGCGCACATTC<br>GGTGGGGGTACTAAAGTAGAAATCAAA (SEQ ID NO: 241) |
| (humanized):<br>QVQLVQSGAEVKKP<br>GSSVKVSCKASGYT<br>FTSYHIHWVRQAPG<br>QGLEWIGWIYPGNV<br>NTEYNEKFKGKATI<br>TADESTNTAYMELS<br>SLRSEDTAVYYCAR<br>EEITYAMDYWGQG<br>TLVTVSSGGGGSGG<br>GGSGGGGSGGDIQM<br>TQSPSTLSASVGDR<br>VTITCRSSQSIVHSN<br>GNTYLEWYQQKPG<br>KAPKLLIYKVSNRFS<br>GVPARFSGSGSGTEF<br>TLTISSLQPDDFATY<br>YCFQGSHVPRTFGQ<br>GTKVEVK (SEQ ID<br>NO: 95) | (humanized):<br>CAGGTGCAGCTGGTGCAGTCTGGGGCTGAGGTGAAGAAG<br>CCTGGGTCCTCAGTGAAGGTTTCCTGCAAGGCTTCTGGAT<br>ACACCTTCACTAGCTATCATATACATTGGGTGCGCCAGGC<br>CCCCGGACAAGGGCTTGAGTGGATCGGATGGATCTACCCT<br>GGCAATGTTAACACAGAATATAATGAGAAGTTCAAGGGC<br>AAAGCCACCATTACCGCGGACGAATCCACGAACACAGCC<br>TACATGGAGCTGAGCAGCCTGAGATCTGAAGACACGGCT<br>GTGTATTACTGTGCGAGGGAGGAAATTACCTACGCTATGG<br>ACTACTGGGGCCAGGGAACCCTGGTCACCGTGTCCTCAGG<br>CGGAGGTGGAAGCGGAGGGGGAGGATCTGGCGGCGGAG<br>AAGCGGAGGCGACATTCAAATGACCCAGAGCCCATCCAC<br>CCTGAGCGCATCTGTAGGTGACCGGGTCACCATCACTTGT<br>AGATCCAGTCAGAGTATTGTACACAGTAATGGGAACACCT<br>ATTTGGAATGGTATCAGCAGAAACCAGGTAAAGCCCAA<br>AATTGCTCATCTACAAAGTCTCTAACAGATTTAGTGGTGT<br>ACCAGCCAGGTTCAGCGGTTCCGGAAGTGGTACTGAATTC<br>ACCCTCACGATCTCCTCTCTCCAGCCAGATGATTTCGCCAC<br>TTATTACTGTTTTCAAGGTTCACATGTGCCGCGCACATTCG<br>GTCAGGGTACTAAAGTAGAAGTCAAA (SEQ ID NO: 242) |
| (humanized):<br>QVQLVQSGAEVKKP<br>GSSVKVSCKASGYT<br>FTSYHMHWVRQAP<br>GQGLEWIGYIYPGN<br>VNTEYNEKFKGKAT<br>LTADKSTNTAYMEL<br>SSLRSEDTAVYFCA<br>REEITYAMDYWGQ<br>GTLVTVSSGGGGSG<br>GGGSGGGGSGGDV<br>QMTQSPSTLSASVG<br>DRVTITCSSSQSIVH<br>SNGNTYMEWYQQK<br>PGKAPKLLIYKVSN<br>RFSGVPDRFSGSGSG<br>TEFTLTISSLQPDDF<br>ATYYCHQGSHVPRT<br>FGQGTKVEVK (SEQ<br>ID NO: 96) | (humanized):<br>CAGGTGCAGCTGGTGCAGTCTGGGGCTGAGGTGAAGAAG<br>CCTGGGTCCTCAGTGAAGGTTTCCTGCAAGGCTTCTGGAT<br>ACACCTTCACTAGCTATCATATGCATTGGGTGCGCCAGGC<br>CCCCGGACAAGGGCTTGAGTGGATCGGATACATCTACCCT<br>GGCAATGTTAACACAGAATATAATGAGAAGTTCAAGGGC<br>AAAGCCACCCTTACCGCGGACAAATCCACGAACACAGCCT<br>ACATGGAGCTGAGCAGCCTGAGATCTGAAGACACGGCTG<br>TGTATTTCTGTGCGAGGGAGGAAATTACCTACGCTATGGA<br>CTACTGGGGCCAGGGAACCCTGGTCACCGTGTCCTCAGGC<br>GGAGGTGGAAGCGGAGGGGGAGGATCTGGCGGCGGAGG<br>AAGCGGAGGCGACGTTCAAATGACCCAGAGCCCATCCAC<br>CCTGAGCGCATCTGTAGGTGACCGGGTCACCATCACTTGT<br>AGCTCCAGTCAGAGTATTGTACACAGTAATGGGAACACCT<br>ATATGGAATGGTATCAGCAGAAACCAGGTAAAGCCCCAA<br>AATTGCTCATCTACAAAGTCTCTAACAGATTTAGTGGTGT<br>ACCAGACAGGTTCAGCGGTTCCGGAAGTGGTACTGAATTC<br>ACCCTCACGATCTCCTCTCTCCAGCCAGATGATTTCGCCAC<br>TTATTACTGTCATCAAGGTTCACATGTGCCGCGCACATTCG<br>GTCAGGGTACTAAAGTAGAAGTCAAA (SEQ ID NO: 243) |
| HLA-A*02 antigen binding domains | |
| (mouse):<br>QVQLQQSGPELVKP<br>GASVKMSCKASGY<br>TFTSYHIQWVKQRP<br>GQGLEWIGWIYPGD<br>GSTQYNEKFKGKTT<br>LTADKSSTAYMLL<br>SSLTSEDSAIYFCAR<br>EGTYYAMDYWGQG<br>TSVTVSSGGGGSGG<br>GGSGGGGSGGDVL<br>MTQTPLSLPVSLGD<br>QVSISCRSSQSIVHS<br>NGNTYLEWYLQKP<br>GQSPKLLIYKVSNRF<br>SGVPDRFSGSGSGT<br>DFTLKISRVEAEDLG<br>VYYCFQGSHVPRTF<br>GGGTKLEIK (SEQ ID<br>NO: 97) | (mouse):<br>CAGGTGCAGCTGCAGCAGTCTGGGCCTGAGCTGGTGAAGC<br>CTGGGGCCTCAGTGAAGATGTCCTGCAAGGCTTCTGGATA<br>CACCTTCACTAGCTATCATATCCAGTGGGTGAAGCAGAGG<br>CCTGGACAAGGGCTTGAGTGGATCGGATGGATCTACCCTG<br>GCGATGGTAGTACACAGTATAATGAGAAGTTCAAGGGCA<br>AAACCACCCTTACCGCGGACAAATCCTCCAGCACAGCCTA<br>CATGTTGCTGAGCAGCCTGACCTCTGAAGACTCTGCTATC<br>TATTTCTGTGCGAGGGAGGGGACCTACTACGCTATGGACT<br>ACTGGGGCCAGGGAACCTCAGTCACCGTGTCCTCAGGCGG<br>AGGTGGAAGCGGAGGGGGAGGATCTGGCGGCGGAGGAA<br>GCGGAGGCGATGTTTTGATGACCCAGACTCCACTCTCCCT<br>GCCTGTCTCTCTTGGAGACCAAGTCTCCATCTCTTGTAGAT<br>CCAGTCAGAGTATTGTACACAGTAATGGGAACACCTATTT<br>AGAATGGTATCTGCAGAAACCAGGTCAGTCTCCAAAGTTG<br>CTCATCTACAAAGTCTCTAACAGATTTAGTGGTGTACCAG<br>ACAGGTTCAGCGGCAGTGGATCAGGGACAGATTTCACCCT<br>CAAGATCTCGAGAGTGGAGGCTGAGGATCTGGGAGTTTAT<br>TACTGTTTTCAAGGTTCACATGTGCCGCGCACATTCGGTG<br>GAGGTACTAAACTGGAAATCAAA (SEQ ID NO: 244) |
| (humanized):<br>QLQLQESGPGLVKP<br>SETLSLTCTVSGYTF<br>TSYHIQWIRQPPGK<br>GLEWIGWIYPGDGS<br>TQYNEKFKGRATIS<br>VDTSKNQFSLNLDS<br>VSAADTAIYYCARE<br>GTYYAMDYWGKGS | (humanized):<br>CAGCTGCAGCTGCAGGAGTCTGGGCCCGGGCTGGTGAAG<br>CCTTCGGAAACGCTGAGCCTCACCTGCACGGTTTCTGGAT<br>ACACCTTCACCAGCTATCATATCCAGTGGATCCGACAGCC<br>CCCTGGAAAAGGGCTTGAGTGGATCGGATGGATCTACCCT<br>GGCGATGGTTCAACAGTACAATGAGAAGTTCAAGGGC<br>AGAGCCACGATTAGCGTGGACACATCCAAGAACCAATTCT<br>CCCTGAACCTGGACAGCGTGAGTGCTGCGGACACGGCCAT<br>TTATTACTGTGCGAGAGAGGGAACTTACTACGCTATGGAC |

TABLE 5-continued

HLA scFv binding domains

| | |
|---|---|
| TVTVSSGGGSGGG<br>GSGGGGSGGDIQMT<br>QSPSSLSASVGDRVT<br>ITCRSSQSIVHSNGN<br>TYLEWYQQKPGKA<br>PKLLIYKVSNRFSGV<br>PSRFSGSGSGTDFTF<br>TISSLQPEDIATYYC<br>FQGSHVPRTFGPGT<br>KVDIK (SEQ ID NO:<br>98) | TACTGGGGCAAAGGGAGCACGGTCACCGTGTCCTCAGGC<br>GGAGGTGGAAGCGGAGGGGGAGGGATCTGGCGGCGGAGG<br>AAGCGGAGGCGACATCCAGATGACCCAGAGCCCAAGCTC<br>CCTGAGTGCGTCCGTGGGCGACCGCGTGACCATCACTTGC<br>AGATCCTCTCAGTCCATCGTGCACTCCAACGGCAACACGT<br>ACCTCGAGTGGTACCAGCAGAAGCCGGGAAGGCCCCGA<br>AACTGCTCATCTACAAGGTGAGCAACCGGTTCTCCGGCGT<br>CCCCAGCCGCTTCTCAGGGTCCGGCTCGGGGACGGATTTC<br>ACCTTCACGATTAGCAGCTTGCAGCCCGAAGACATCGCCA<br>CGTACTACTGCTTTCAGGGAAGTCACGTGCCGCGTACCTT<br>CGGGCCGGGCACGAAAGTGGATATTAAG (SEQ ID NO: 245) |
| (humanized):<br>EVQLVQSGAELKKP<br>GSSVKVSCKASGYT<br>FTSYHIQWVKQAPG<br>QGLEWIGWIYPGDG<br>STQYNEKFKGKATL<br>TVDKSTNTAYMELS<br>SLRSEDTAVYYCAR<br>EGTYYAMDYWGQG<br>TLVTVSSGGGSGG<br>GGSGGGGSGGDIQM<br>TQSPSTLSASVGDR<br>VTITCRSSQSIVHSN<br>GNTYLEWYQQKPG<br>KAPKLLIYKVSNRFS<br>GVPSRFSGSGSGTDF<br>TLTISSLQPDDFATY<br>YCFQGSHVPRTFGQ<br>GTKVEVK (SEQ ID<br>NO: 99) | (humanized):<br>GAGGTGCAGCTGGTGCAGTCTGGGGCCGAGCTGAAGAAG<br>CCTGGGTCCTCGGTGAAGGTCTCCTGCAAGGCTTCTGGAT<br>ACACCTTCACCAGCTATCATATCCAGTGGGTAAAACAGGC<br>CCCTGGACAAGGGCTTGAGTGGATCGGATGGATCTACCCT<br>GGCGATGGTTCAACACAGTACAATGAGAAGTTCAAGGGC<br>AAAGCCACGCTTACCGTGACAAATCCACGAACACAGCCT<br>ACATGGAGCTGAGCAGCCTGAGATCTGAGGACACGGCCG<br>TATATTACTGTGCGAGAGAGGGAACTTACTACGCTATGGA<br>CTACTGGGGCCAAGGGACCCTGGTCACCGTGTCCTCAGGC<br>GGAGGTGGAAGCGGAGGGGGAGGGATCTGGCGGCGGAGG<br>AAGCGGAGGCGACATCCAGATGACCCAGAGCCCATCCAC<br>CCTGAGTGCGTCCGTGGGCGACCGCGTGACCATCACTTGC<br>AGATCCTCTCAGTCCATCGTGCACTCCAACGGCAACACGT<br>ACCTCGAGTGGTACCAGCAGAAGCCCGGGAAGGCCCCGA<br>AACTGCTCATCTACAAGGTGAGCAACCGGTTCTCCGGCGT<br>CCCCAGCCGCTTCTCAGGGTCCGGCTCGGGGACGGATTTC<br>ACCCTCACGATTAGCAGCTTGCAGCCCGATGACTTCGCCA<br>CGTACTACTGCTTTCAGGGAAGTCACGTGCCGCGTACCTT<br>CGGGCAGGGCACGAAAGTGGAAGTTAAG (SEQ ID NO: 246) |
| (humanized):<br>QVQLVQSGAEVKKP<br>GSSVKVSCKASGYT<br>FTSYHIQWVRQAPG<br>QGLEWMGWIYPGD<br>GSTQYNEKFKGRVT<br>ITADKSTSTAYMELS<br>SLRSEDTAVYYCAR<br>EGTYYAMDYWGQG<br>TTVTVSSGGGSGG<br>GGSGGGGSGGEIVL<br>TQSPGTLSLSPGERA<br>TLSCRSSQSIVHSNG<br>NTYLEWYQQKPGQ<br>APRLLIYKVSNRFSG<br>IPDRFSGSGSGTDFT<br>LTISRLEPEDFAVYY<br>CFQGSHVPRTFGGG<br>TKVEIK (SEQ ID NO:<br>100) | (humanized):<br>CAGGTGCAGCTGGTGCAGTCTGGGGCCGAGGTGAAGAAG<br>CCTGGGTCCTCGGTGAAGGTGTCCTGCAAGGCTTCTGGAT<br>ACACCTTCACCAGCTATCATATCCAGTGGGTACGACAGGC<br>CCCTGGACAAGGGCTTGAGTGGATGGGATGGATCTACCCT<br>GGCGATGGTTCAACACAGTACAATGAGAAGTTCAAGGGC<br>AGAGTCACGATTACCGACAAATCCACGAGCACAGCCT<br>ACATGGAGCTGAGCAGCCTGAGATCTGAGGACACGGCC<br>GTATATTACTGTGCGAGAGAGGGAACTTACTACGCTATGG<br>ACTACTGGGGCCAAGGGACCACGGTCACCGTGTCCTCAGG<br>CGGAGGTGGAAGCGGAGGGGGGAGGGATCTGGCGGCGGAGG<br>AAGCGGAGGCGAGATCGTCCTGACCCAGAGCCCAGGGAC<br>CCTGAGTTTGTCCCCGGGCGAGCGCGCGACCCTCAGTTGC<br>AGATCCTCTCAGTCCATCGTGCACTCCAACGGCAACACGT<br>ACCTCGAGTGGTACCAGCAGAAGCCCGGGCAGGCCCCGC<br>GACTGCTCATCTACAAGGTGAGCAACCGGTTCTCCGGCAT<br>CCCCGACCGCTTCTCAGGGTCCGGCTCGGGGACGGATTTC<br>ACCCTCACGATTAGCCGCTTGGAGCCCGAAGACTTCGCCG<br>TGTACTACTGCTTTCAGGGAAGTCACGTGCCGCGTACCTT<br>CGGGGGGGGCACGAAAGTGGAAATTAAG (SEQ ID NO: 247) |
| (humanized):<br>QVTLKQSGAEVKKP<br>GSSVKVSCTASGYT<br>FTSYHVSWVRQAPG<br>QGLEWLGRIYPGDG<br>STQYNEKFKGKVTI<br>TADKSMDTSFMELT<br>SLTSEDTAVYYCAR<br>EGTYYAMDLWGQG<br>TLVTVSSGGGSGG<br>GGSGGGGSGGEIVL<br>TQSPGTLSLSPGERA<br>TLSCRSSQSIVHSNG<br>NTYLAWYQQKPGQ<br>APRLLISKVSNRFSG<br>VPDRFSGSGSGTDFT<br>LTISRLEPEDFAVYY<br>CQQGSHVPRTFGGG<br>TKVEIK (SEQ ID NO:<br>101) | (humanized):<br>CAGGTGACCCTGAAGCAGTCTGGGGCCGAGGTGAAGAAG<br>CCTGGGTCCTCGGTGAAGGTGTCCTGCACGGCTTCTGGAT<br>ACACCTTCACCAGCTATCATGTCAGCTGGGTACGACAGGC<br>CCCTGGACAAGGGCTTGAGTGGTTGGGAAGGATCTACCCT<br>GGCGATGGTTCAACACAGTACAATGAGAAGTTCAAGGGC<br>AAAGTCACGATTACCGACAAATCCATGGACACATCCT<br>TCATGGAGCTGACCAGCCTGACATCTGAGGACACGGCCGT<br>ATATTACTGTGCGAGAGAGGGAACTTACTACGCTATGGAC<br>CTCTGGGGCCAAGGGACCCTGGTCACCGTGTCCTCAGGCG<br>GAGGTGGAAGCGGAGGGGGGAGGATCTGGCGGCGGAGGA<br>AGCGGAGGCGAGATCGTCCTGACCCAGAGCCCAGGGACC<br>CTGAGTTTGTCCCCGGGCGAGCGCGCGACCCTCAGTTGCA<br>GATCCTCTCAGTCCATCGTGCACTCCAACGGCAACACGTA<br>CCTCGCGTGGTACCAGCAGAAGCCCGGGCAGGCCCCGCG<br>ACTGCTCATCTCCAAGGTGAGCAACCGGTTCTCCGGCGTC<br>CCCGACCGCTTCTCAGGGTCCGGCTCGGGGACGGATTTCA<br>CCCTCACGATTAGCCGCTTGGAGCCCGAAGACTTCGCCGT<br>GTACTACTGCCAACAGGGAAGTCACGTGCCGCGTACCTTC<br>GGGGGGGGCACGAAAGTGGAAATTAAG (SEQ ID NO: 248) |
| (humanized):<br>QVQLVQSGAEVKKP<br>GASVKVSCKASGYT | (humanized):<br>CAGGTGCAGCTGGTGCAGTCTGGGGCCGAGGTGAAGAAG<br>CCTGGGGCCTCGGTGAAGGTGTCCTGCAAGGCTTCTGGAT |

TABLE 5-continued

| HLA scFv binding domains | |
|---|---|
| FTSYHMHWVRQAP GQRLEWMGWIYPG DGSTQYNEKFKGKV TITRDTSASTAYMEL SSLRSEDTAVYYCA REGTYYAMDYWGQ GTLVTVSSGGGGSG GGGSGGGGSGGDIV MTQTPLSLPVTPGEP ASISCRSSQSIVHSN GNTYLDWYLQKPG QSPQLLIYKVSNRFS GVPDRFSGSGSGTD FTLKISRVEAEDVG VYYCMQGSHVPRTF GGGTKVEIK (SEQ ID NO: 102) | ACACCTTCACCAGCTATCATATGCACTGGGTACGACAGGC CCCTGGACAAAGGCTTGAGTGGATGGGATGGATCTACCCT GGCGATGGTTCAACACAGTACAATGAGAAGTTCAAGGGC AAAGTCACGATTACCCGGGACACATCCGCGAGCACAGCCT ACATGGAGCTGAGCAGCCTGAGATCTGAGGACACGGCCG TATATTACTGTGCGAGAGAGGGAACTTACTACGCTATGGA CTACTGGGGCCAAGGGACCCTGGTCACCGTGTCCTCAGGC GGAGGTGGAAGCGGAGGGGGAGGATCTGGCGGCGGAGG AAGCGGAGGCGACATCGTCATGACCCAGACCCCACTGTCC CTGCCTGTGACCCCGGGCGAGCCCGCGAGCATCAGTTGCA GATCCTCTCAGTCCATCGTGCACTCCAACGGCAACACGTA CCTCGACTGGTACCTGCAGAAGCCCGGGCAGTCCCCGCAA CTGCTCATCTACAAGGTGAGCAACCGGTTCTCCGGCGTCC CCGACCGCTTCTCAGGGTCCGGCTCGGGGACGGATTTCAC CCTCAAGATTAGCCGCGTGGAGGCCGAAGACGTCGGCGT GTACTACTGCATGCAGGGAAGTCACGTGCCGCGTACCTTC GGGGGGGGCACGAAAGTGGAAATTAAG (SEQ ID NO: 249) |
| HLA-B*07 antigen binding domains | |
| 1.10_scFv | QVQLQESGPGLVKPSQTLSLTCTVSGYSITSGYSWHWIRQPP GKGLEWIGYIHFSGSTHYHPSLKSRVTISVDTSKNQFSLKLSS VTAADTAVYYCARGGVVSHYAMDCWGQGTTVTVSSGGGG SGGGGSGGGGSGGDIQMTQSPSSLSASVGDRVTITCRASENI YSNLAWYQQKPGKAPKLLIYAATYLPDGVPSRFSGSGSGTD FTLTISSLQPEDFATYYCQHFWVTPYTFGGGTKVEIK (SEQ ID NO: 250) |
| 1.9_scFv | EVQLVESGGGLVKPGGSLRLSCAASGYSITSGYSWHWVRQA PGKGLEWVSYIHFSGSTHYHPSLKSRFTISRDNAKNSLYLQM NSLRAEDTAVYYCARGGVVSHYAMDCWGQGTTVTVSSGG GGSGGGGSGGGGSGGDIQMTQSPSSVSASVGDRVTITCRASE NIYSNLAWYQQKPGKAPKLLIYAATYLPDGVPSRFSGSGSGT DFTLTISSLQPEDFATYYCQHFWVTPYTFGGGTKVEIK (SEQ ID NO: 251) |
| 1.8_scFv | EVQLVESGGGLVKPGGSLRLSCAASGYSITSGYSWHWVRQA PGKGLEWVGYIHFSGSTHYHPSLKSRFTISRDDSKNTLYLQM NSLKTEDTAVYYCARGGVVSHYAMDCWGQGTTVTVSSGG GGSGGGGSGGGGSGGEIVLTQSPATLSLSPGERATLSCRASE NIYSNLAWYQQKPGQAPRLLIYAATYLPDGIPARFSGSGSGT DFTLTISSLEPEDFAVYYCQHFWVTPYTFGGGTKVEIK (SEQ ID NO: 252) |
| 1.7_scFv | QVQLQQSGPGLVKPSQTLSLTCAISGYSITSGYSWHWIRQSPS RGLEWLGYIHFSGSTHYHPSLKSRITINPDTSKNQFSLQLNSV TPEDTAVYYCARGGVVSHYAMDCWGQGTTVTVSSGGGGS GGGGSGGGGSGGEIVLTQSPATLSLSPGERATLSCRASENIYS NLAWYQQKPGQAPRLLIYAATYLPDGIPARFSGSGSGTDFTL TISRLEPEDFAVYYCQHFWVTPYTFGGGTKVEIK (SEQ ID NO: 253) |
| 1.6_scFv | EVQLVESGGGLVKPGGSLRLSCAASGYSITSGYSWHWVRQA PGKGLEWVGYIHFSGSTHYHPSLKSRFTISRDDSKNTLYLQM NSLKTEDTAVYYCARGGVVSHYAMDCWGQGTTVTVSSGG GGSGGGGSGGGGSGGDIQMTQSPSSVSASVGDRVTITCRASE NIYSNLAWYQQKPGKAPKLLIYAATYLPDGVPSRFSGSGSGT DFTLTISSLQPEDFATYYCQHFWVTPYTFGGGTKVEIK (SEQ ID NO: 254) |
| 1.5_scFv | EVQLVESGGGLVQPGGSLRLSCAASGYSITSGYSWHWVRQA PGKGLEWVSYIHFSGSTHYHPSLKSRFTISRDNSKNTLYLQM NSLRAEDTAVYYCARGGVVSHYAMDCWGQGTTVTVSSGG GGSGGGGSGGGGSGGDIQMTQSPSSLSASVGDRVTITCRASE NIYSNLAWYQQKPGKAPKLLIYAATYLPDGVPSRFSGSGSGT DFTLTISSLQPEDFATYYCQHFWVTPYTFGGGTKVEIK (SEQ ID NO: 255) |
| 1.4_scFv | EVQLVESGGGLVKPGGSLRLSCAASGYSITSGYSWHWVRQA PGKGLEWVGYIHFSGSTHYHPSLKSRFTISRDDSKNTLYLQM NSLKTEDTAVYYCARGGVVSHYAMDCWGQGTTVTVSSGG GGSGGGGSGGGGSGGDIQMTQSPSSLSASVGDRVTITCRASE NIYSNLAWYQQKPGKAPKLLIYAATYLPDGVPSRFSGSGSGT DFTLTISSLQPEDFATYYCQHFWVTPYTFGGGTKVEIK (SEQ ID NO: 256) |

TABLE 5-continued

| HLA scFv binding domains | |
|---|---|
| 1.3_scFv | QVQLQQWGAGLLKPSETLSLTCAVYGYSITSGYSWHWIRQP<br>PGKGLEWIGYIHFSGSTHYHPSLKSRVTISVDTSKNQFSLKLS<br>SVTAADTAVYYCARGGVVSHYAMDCWGQGTTVTVSSGGG<br>GSGGGGSGGGGSGGDIQMTQSPSSLSASVGDRVTITCRASEN<br>IYSNLAWYQQKPGKAPKLLIYAATYLPDGVPSRFSGSGSGTD<br>FTLTISSLQPEDFATYYCQHFWVTPYTFGGGTKVEIK (SEQ ID<br>NO: 257) |
| 1.2_scFv | QVQLQESGPGLVKPSQTLSLTCTVSGYSITSGYSWHWIRQHP<br>GKGLEWIGYIHFSGSTHYHPSLKSRVTISVDTSKNQFSLKLSS<br>VTAADTAVYYCARGGVVSHYAMDCWGQGTTVTVSSGGGG<br>SGGGGSGGGGSGGDIQMTQSPSSLSASVGDRVTITCRASENI<br>YSNLAWYQQKPGKAPKLLIYAATYLPDGVPSRFSGSGSGTD<br>FTLTISSLQPEDFATYYCQHFWVTPYTFGGGTKVEIK (SEQ ID<br>NO: 258) |
| 1.1_scFv | QVQLQQSGPGLVKPSQTLSLTCAISGYSITSGYSWHWIRQSPS<br>RGLEWLGYIHFSGSTHYHPSLKSRITINPDTSKNQFSLQLNSV<br>TPEDTAVYYCARGGVVSHYAMDCWGQGTTVTVSSGGGGS<br>GGGGSGGGGSGGDIQMTQSPSSLSASVGDRVTITCRASENIY<br>SNLAWYQQKPGKAPKLLIYAATYLPDGVPSRFSGSGSGTDFT<br>LTISSLQPEDFATYYCQHFWVTPYTFGGGTKVEIK (SEQ ID<br>NO: 259) |

| HLA-A*11 antigen binding domains | |
|---|---|
| QVQLQESGPGLVKPSQTLSLTCTVSGGSISSGGYYVVSWIRQPPGKGLEWIGYIYYSGSTYYNPSLKSRVTISVDTSKNQFSLKLSSVTAADTAVYYCARHYYYYSMDVWGKGTTVTVSSGGGGSGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK (SEQ ID NO: 260) | CAGGTGCAGCTGCAGGAAAGCGGCCCTGGCCTGGTGAAAC<br>CCAGCCAGACCCTGAGCCTGACCTGCACAGTGTCCGGCG<br>GCTCGATCAGCAGCGGCGGCTACTACTGGTCCTGGATCAG<br>ACAGCCCCCTGGCAAGGGCCTGGAATGGATCGGCTACATC<br>TACTACAGCGGCAGCACCTACTACAACCCCAGCCTGAAGT<br>CCAGAGTGACCATCAGCGTGGACACCAGCAAGAACCAGT<br>TCAGCCTGAAGCTGAGCAGCGTGACAGCCGCCGACACCG<br>CTGTGTATTACTGTGCGAGACACTACTACTACTACTCCATG<br>GACGTCTGGGGCAAAGGGACCACGGTCACCGTGTCCTCAG<br>GCGGAGGTGGAAGCGGAGGGGGAGGATCTGGCGGCGGAG<br>GAAGCGGAGGCGACATCCAGATGACCCAGTCTCCATCCTC<br>CCTGTCTGCATCTGTAGGAGACAGAGTCACCATCACTTGC<br>CGGGCAAGTCAGAGCATTAGCAGCTATTTAAATTGGTATC<br>AGCAGAAACCAGGGAAAGCCCCTAAGCTCCTGATCTATGC<br>TGCATCCAGTTTGCAAAGTGGGGTCCCATCAAGGTTCAGT<br>GGCAGTGGATCTGGGACAGATTTCACTCTCACCATCAGCA<br>GTCTGCAACCTGAAGATTTTGCAACTTACTACTGTCAACA<br>GAGTTACAGTACCCCTCTCACTTTCGGCGGCGGAACAAAG<br>GTGGAGATCAAG (SEQ ID NO: 261) |
| QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHRHMRLSCFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK (SEQ ID NO: 262) | CAGATCACCCTGAAAGAGTCCGGCCCCACCCTGGTGAAAC<br>CCACCCAGACCCTGACCCTGACATGCACCTTCAGCGGCTT<br>CAGCCTGAGCACCTCTGGCGTGGGCGTGGGCTGGATCAGA<br>CAGCCTCCCGGCAAGGCCCTGGAATGGCTGGCCCTGATCT<br>ACTGGAACGACGACAAGCGGTACAGCCCCAGCCTGAAGT<br>CCCGGCTGACCATCACCAAGGACACCTCGAAGAACCAGG<br>TGGTGCTGACCATGACAAACATGGACCCCGTGGACACCGC<br>CACATATTACTGTGCACACAGACACATGCGTTTAAGCTGT<br>TTTGACTACTGGGGCCAGGGAACCCTGGTCACCGTGTCCT<br>CAGGCGGAGGTGGAAGCGGAGGGGGAGGATCTGGCGGCG<br>GAGGAAGCGGAGGCGACATCCAGATGACCCAGTCTCCAT<br>CCTCCCTGTCTGCATCTGTAGGAGACAGAGTCACCATCAC<br>TTGCCGGGCAAGTCAGAGCATTAGCAGCTATTTAAATTGG<br>TATCAGCAGAAACCAGGGAAAGCCCCTAAGCTCCTGATCT<br>ATGCTGCATCCAGTTTGCAAAGTGGGGTCCCATCAAGGTT<br>CAGTGGCAGTGGATCTGGGACAGATTTCACTCTCACCATC<br>AGCAGTCTGCAACCTGAAGATTTTGCAACTTACTACTGTC<br>AACAGAGTTACAGTACCCCTCTCACTTTCGGCGGCGGAAC<br>AAAGGTGGAGATCAAG (SEQ ID NO: 263) |
| QVQLVQSGAEVKKPGASVKVSCKASGYTFTSYAMHWVRQAPGQRLEWMGWINAGNGNTKYSQKFQGRVTITRDTSASTAYMELSSLRSEDTAVYYCAREGNGANPDAFDIWGQGTMVTVSGGGGSGGGGSGGGSGGDIQMTQSPSSLSASVGDRVTITCRASQS | CAGGTGCAGCTGGTGCAGTCTGGCGCCGAAGTGAAGAAA<br>CCTGGCGCCTCCGTGAAGGTGTCCTGCAAGGCCAGCGGCT<br>ACACCTTCACCAGCTACGCCATGCACTGGGTTCGACAGGC<br>CCCTGGCCAGAGACTGGAATGGATGGGCTGGATCAACGC<br>CGGCAACGGCAACACCAAGTACAGCCAGAAATTCCAGGG<br>CAGAGTGACCATCACCCGGGACACCAGCGCCAGCACCGC<br>CTACATGGAACTGAGCAGCCTGCGGAGCGAGGACACCGC<br>TGTGTATTACTGTGCGAGAGAAGGAAATGGTGCCAACCCT<br>GATGCTTTTGATATCTGGGGCCAAGGGACAATGGTCACCG<br>TGTCCTCAGGCGGAGGTGGAAGCGGAGGGGGAGGATCTG<br>GCGGCGGAGGAAGCGGAGGCGACATCCAGATGACCCAGT<br>CTCCATCCTCCCTGTCTGCATCTGTAGGAGACAGAGTCAC |

TABLE 5-continued

HLA scFv binding domains

| | |
|---|---|
| ISSYLNWYQQKPGK APKLLIYAASSLQSG VPSRFSGSGSGTDFT LTISSLQPEDFATYY CQQSYSTPLTFGGG TKVEIK (SEQ ID NO: 264) | CATCACTTGCCGGGCAAGTCAGAGCATTAGCAGCTATTTA AATTGGTATCAGCAGAAACCAGGGAAAGCCCCTAAGCTC CTGATCTATGCTGCATCCAGTTTGCAAAGTGGGGTCCCAT CAAGGTTCAGTGGCAGTGGATCTGGGACAGATTTCACTCT CACCATCAGCAGTCTGCAACCTGAAGATTTTGCAACTTAC TACTGTCAACAGAGTTACAGTACCCCTCTCACTTTCGGCG GCGGAACAAAGGTGGAGATCAAG (SEQ ID NO: 265) |
| EVQLVESGGGLVQP GGSLRLSCAASGFTF SSYDMHWVRQATG KGLEWVSAIGTAGD TYYPGSVKGRFTISR ENAKNSLYLQMNSL RAGDTAVYYCARD LPGSYWYFDLWGR GTLVTVSSGGGGSG GGGSGGGGSGGDIQ MTQSPSSLSASVGD RVTITCRASQSISSY LNWYQQKPGKAPK LLIYAASSLQSGVPS RFSGSGSGTDFTLTI SSLQPEDFATYYCQ QSYSTPLTFGGGTK VEIK (SEQ ID NO: 266) | GAAGTGCAGCTGGTGGAAAGCGGCGGAGGCCTGGTGCAG CCTGGCGGCAGCCTGAGACTGTCTTGCGCCGCCAGCGGCT TCACCTTCAGCAGCTACGACATGCACTGGGTCCGCCAGGC CACCGGCAAGGGACTGGAATGGGTGTCCGCCATCGGCAC AGCCGGCGACACTTACTACCCCGGCAGCGTGAAGGGCCG GTTCACCATCAGCAGAGAGAACGCCAAGAACAGCCTGTA CCTGCAGATGAACAGCCTTCGGCCGGCGATACCGCCGTG TATTACTGTGCAAGAGATCTCCCTGGTAGCTACTGGTACTT CGATCTCTGGGGCCGTGGCACCCTGGTCACTGTGTCCTCA GGCGGAGGTGGAAGCGGAGGGGGAGGATCTGGCGGCGGA GGAAGCGGAGGCGGACATCCAGATGACCCAGTCTCCATCCT CCCTGTCTGCATCTGTAGGAGACAGAGTCACCATCACTTG CCGGGCAAGTCAGAGCATTAGCAGCTATTTAAATTGGTAT CAGCAGAAACCAGGGAAAGCCCCTAAGCTCCTGATCTATG CTGCATCCAGTTTGCAAAGTGGGGTCCCATCAAGGTTCAGT GGCAGTGGATCTGGGACAGATTTCACTCTCACCATCAGC AGTCTGCAACCTGAAGATTTTGCAACTTACTACTGTCAAC AGAGTTACAGTACCCCTCTCACTTTCGGCGGCGGAACAAA GGTGGAGATCAAG (SEQ ID NO: 267) |
| QVQLQESGPGLVKP SQTLSLTCTVSGGSI SSGGYYWSWIRQPP GKGLEWIGYIYYSG STYYNPSLKSRVTIS VDTSKNQFSLKLSS VTAADTAVYYCAR HYYYYLDVWGKG TTVTVSSGGGGSGG GGSGGGGSGGDIQM TQSPSSLSASVGDRV TITCRASQSISSYLN WYQQKPGKAPKLLI YAASSLQSGVPSRFS GSGSGTDFTLTISSL QPEDFATYYCQQSY STPLTFGGGTKVEIK (SEQ ID NO: 268) | CAGGTGCAGCTGCAGGAAAGCGGCCCTGGCCTGGTGAAA CCCAGCCAGACCCTGAGCCTGACCTGCACAGTGTCCGGCG GCTCGATCAGCAGCGGCGGCTACTACTGGTCCTGGATCAG ACAGCCCCCTGGCAAGGGCCTGGAATGGATCGGCTACATC TACTACAGCGGCAGCACCTACTACAACCCCAGCCTGAAGT CCAGAGTGACCATCAGCGTGGACACCAGCAAGAACCAGT TCAGCCTGAAGCTGAGCAGCGTGACAGCCGCCGACACCG CTGTGTATTACTGTGCGAGACACTACTACTACTACCTG GACGTCTGGGGCAAAGGGACCACGGTCACCGTGTCCTCAG GCGGAGGTGGAAGCGGAGGGGGAGGATCTGGCGGCGGAG GAAGCGGAGGCGGACATCCAGATGACCCAGTCTCCATCCTC CCTGTCTGCATCTGTAGGAGACAGAGTCACCATCACTTGC CGGGCAAGTCAGAGCATTAGCAGCTATTTAAATTGGTATC AGCAGAAACCAGGGAAAGCCCCTAAGCTCCTGATCTATGC TGCATCCAGTTTGCAAAGTGGGGTCCCATCAAGGTTCAGT GGCAGTGGATCTGGGACAGATTTCACTCTCACCATCAGCA GTCTGCAACCTGAAGATTTTGCAACTTACTACTGTCAACA GAGTTACAGTACCCCTCTCACTTTCGGCGGCGGAACAAAG GTGGAGATCAAG (SEQ ID NO: 269) |
| EVQLVESGGGLVQP GGSLRLSCAASGFTF SSYWMHWVRQAPG KGLVWVSRINSDGS STSYADSVKGRFTIS RDNAKNTLYLQMN SLRAEDTAVYYCCL GVLLYNWFDPWGQ GTLVTVSSGGGGSG GGGSGGGGSGGDIQ MTQSPSSLSASVGD RVTITCRASQSISSY LNWYQQKPGKAPK LLIYAASSLQSGVPS RFSGSGSGTDFTLTI SSLQPEDFATYYCQ QSYSTPLTFGGGTK VEIK (SEQ ID NO: 270) | GAAGTGCAGCTGGTGGAAAGCGGCGGAGGCCTGGTGCAG CCTGGCGGCAGCCTGAGACTGTCTTGCGCCGCCAGCGGCT TCACCTTCAGCAGCTACTGGATGCACTGGGTCCGCCAGGC CCCTGGCAAGGGACTGGTCTGGGTGTCTCGAATCAACAGC GACGGCAGCAGCACCAGCTACGCCGACAGCGTGAAGGGC CGGTTCACCATCAGCCGGGACAACGCCAAGAACACCCTGT ACCTGCAGATGAACAGCCTGCGGGCCGAGGACACCGCCG TGTATTACTGTTGTTTGGGTGTTTTATTATACAACTGGTTC GACCCCTGGGGCCAGGGAACCCTGGTCACCGTGTCCTCAG GCGGAGGTGGAAGCGGAGGGGGAGGATCTGGCGGCGGAG GAAGCGGAGGCGGACATCCAGATGACCCAGTCTCCATCCTC CCTGTCTGCATCTGTAGGAGACAGAGTCACCATCACTTGC CGGGCAAGTCAGAGCATTAGCAGCTATTTAAATTGGTATC AGCAGAAACCAGGGAAAGCCCCTAAGCTCCTGATCTATGC TGCATCCAGTTTGCAAAGTGGGGTCCCATCAAGGTTCAGT GGCAGTGGATCTGGGACAGATTTCACTCTCACCATCAGCA GTCTGCAACCTGAAGATTTTGCAACTTACTACTGTCAACA GAGTTACAGTACCCCTCTCACTTTCGGCGGCGGAACAAAG GTGGAGATCAAG (SEQ ID NO: 271) |
| QVQLQESGPGLVKP SQTLSLTCTVSGGSI SSGGYYWSWIRQPP GKGLEWIGYIYYSG STYYNPSLKSRVTIS VDTSKNQFSLKLSS VTAADTAVYYCAR HYYYYMDVWGKG TTVTVSSGGGGSGG GGSGGGGSGGDIQM | CAGGTGCAGCTGCAGGAAAGCGGCCCTGGCCTGGTGAAA CCCAGCCAGACCCTGAGCCTGACCTGCACAGTGTCCGGCG GCTCGATCAGCAGCGGCGGCTACTACTGGTCCTGGATCAG ACAGCCCCCTGGCAAGGGCCTGGAATGGATCGGCTACATC TACTACAGCGGCAGCACCTACTACAACCCCAGCCTGAAGT CCAGAGTGACCATCAGCGTGGACACCAGCAAGAACCAGT TCAGCCTGAAGCTGAGCAGCGTGACAGCCGCCGACACCG CTGTGTATTACTGTGCAGAGACACTACTACTACTACATGGA CGTCTGGGGCAAAGGGACCACGGTCACCGTGTCCTCAGGC GGAGGTGGAAGCGGAGGGGGAGGATCTGGCGGCGGAGG |

TABLE 5-continued

HLA scFv binding domains

| | |
|---|---|
| TQSPSSLSASVGDRV<br>TITCRASQSISSYLN<br>WYQQKPGKAPKLLI<br>YAASSLQSGVPSRFS<br>GSGSGTDFTLTISSL<br>QPEDFATYYCQQSY<br>STPLTFGGGTKVEIK<br>(SEQ ID NO: 272) | AAGCGGAGGCGACATCCAGATGACCCAGTCTCCATCCTCC<br>CTGTCTGCATCTGTAGGAGACAGAGTCACCATCACTTGCC<br>GGGCAAGTCAGAGCATTAGCAGCTATTTAAATTGGTATCA<br>GCAGAAACCAGGGAAAGCCCCTAAGCTCCTGATCTATGCT<br>GCATCCAGTTTGCAAAGTGGGGTCCCATCAAGGTTCAGTG<br>GCAGTGGATCTGGGACAGATTTCACTCTCACCATCAGCAG<br>TCTGCAACCTGAAGATTTTGCAACTTACTACTGTCAACAG<br>AGTTACAGTACCCCTCTCACTTTCGGCGGCGGAACAAAGG<br>TGGAGATCAAG (SEQ ID NO: 273) |
| QITLKESGPTLVKPT<br>QTLTLTCTFSGFSLS<br>TSGVGVGWIRQPPG<br>KALEWLALIYWND<br>DKRYSPSLKSRLTIT<br>KDTSKNQVVLTMT<br>NMDPVDTATYYCA<br>HKTTSFYFDYWGQ<br>GTLVTVSSGGGGSG<br>GGGSGGGGSGGDIQ<br>MTQSPSSLSASVGD<br>RVTITCRASQSISSY<br>LNWYQQKPGKAPK<br>LLIYAASSLQSGVPS<br>RFSGSGSGTDFTLTI<br>SSLQPEDFATYYCQ<br>QSYSTPLTFGGGTK<br>VEIK (SEQ ID NO:<br>274) | CAGATACCCCTGAAAGAGTCCGGCCCCACCCTGGTGAAAC<br>CCACCCAGACCCTGACCCTGACATGCACCTTCAGCGGCTT<br>CAGCCTGAGCACCTCTGGCGTGGGCGTGGGCTGGATCAGA<br>CAGCCTCCCGGCAAGGCCCTGGAATGGCTGGCCCTGATCT<br>ACTGGAACGACGACAAGCGGTACAGCCCCAGCCTGAAGT<br>CCCGGCTGACCATCACCAAGGACACCTCGAAGAACCAGG<br>TGGTGCTGACCATGACAAACATGGACCCCGTGGACACCGC<br>CACATATTACTGTGCACACAAAACGACGTCGTTTTACTTT<br>GACTACTGGGGCCAGGGAACCCTGGTCACCGTGTCCTCAG<br>GCGGAGGTGGAAGCGGAGGGGGAGGATCTGGCGGCGGAG<br>GAAGCGGAGGCGACATCCAGATGACCCAGTCTCCATCCTC<br>CCTGTCTGCATCTGTAGGAGACAGAGTCACCATCACTTGC<br>CGGGCAAGTCAGAGCATTAGCAGCTATTTAAATTGGTATC<br>AGCAGAAACCAGGGAAAGCCCCTAAGCTCCTGATCTATGC<br>TGCATCCAGTTTGCAAAGTGGGGTCCCATCAAGGTTCAGT<br>GGCAGTGGATCTGGGACAGATTTCACTCTCACCATCAGCA<br>GTCTGCAACCTGAAGATTTTGCAACTTACTACTGTCAACA<br>GAGTTACAGTACCCCTCTCACTTTCGGCGGCGGAACAAAG<br>GTGGAGATCAAG (SEQ ID NO: 275) |
| QVQLQESGPGLVKP<br>SQTLSLTCTVSGGSI<br>SSGGYYWSWIRQPP<br>GKGLEWIGYIYYSG<br>STYYNPSLKSRVTIS<br>VDTSKNQFSLKLSS<br>VTAADTAVYYCAR<br>HYYYYYMDVWGK<br>GTTVTVSSGGGGSG<br>GGGSGGGGSGGDIQ<br>MTQSPSSLSASVGD<br>RVTITCRASQSISSY<br>LNWYQQKPGKAPK<br>LLIYAASSLQSGVPS<br>RFSGSGSGTDFTLTI<br>SSLQPEDFATYYCQ<br>QSYSTPLTFGGGTK<br>VEIK (SEQ ID NO:<br>276) | CAGGTGCAGCTGCAGGAAAGCGGCCCTGGCCTGGTGAAA<br>CCCAGCCAGACCCTGAGCCTGACCTGCACAGTGTCCGGCG<br>GCTCGATCAGCAGCGGCGGCTACTACTGGTCCTGGATCAG<br>ACAGCCCCCTGGCAAGGGCCTGGAATGGATCGGCTACATC<br>TACTACAGCGGCAGCACCTACTACAACCCCAGCCTGAAGT<br>CCAGAGTGACCATCAGCGTGGACACCAGCAAGAACCAGT<br>TCAGCCTGAAGCTGAGCAGCGTGACAGCCGCCGACACCG<br>CTGTGTATTACTGTGCGAGACCTACTACTACTACTACAT<br>GGACGTCTGGGGCAAAGGGACCACGGTCACCGTGTCCTCA<br>GGCGGAGGTGGAAGCGGAGGGGGAGGATCTGGCGGCGGA<br>GGAAGCGGAGGCGACATCCAGATGACCCAGTCTCCATCCT<br>CCCTGTCTGCATCTGTAGGAGACAGAGTCACCATCACTTG<br>CCGGGCAAGTCAGAGCATTAGCAGCTATTTAAATTGGTAT<br>CAGCAGAAACCAGGGAAAGCCCCTAAGCTCCTGATCTATG<br>CTGCATCCAGTTTGCAAAGTGGGGTCCCATCAAGGTTCAG<br>TGGCAGTGGATCTGGGACAGATTTCACTCTCACCATCAGC<br>AGTCTGCAACCTGAAGATTTTGCAACTTACTACTGTCAAC<br>AGAGTTACAGTACCCCTCTCACTTTCGGCGGCGGAACAAA<br>GGTGGAGATCAAG (SEQ ID NO: 277) |

HLA-C*07 antigen binding domains

| | |
|---|---|
| C7-45 | EVQLLESGGGLVQPGGSLRLSCAASGFTFSSYAMSWVRQAPGKGLEWVSAISGSG<br>GSTYYADSVKGRFTISRDNSKNTLYLQMNSLRAEDTAVYYCAVSFDWFDPWGQG<br>TLVTVSSGGGGSGGGGSGGGGSGGDIQMTQSPSSLSASVGDRVTITCRASQSISSY<br>LNWYQQKPGKAPKLLIYAASSLQSGVPSRFSGSGSGTDFTLTISSLQPEDFATYYCQ<br>QSYSTPLTFGGGTKVEIK (SEQ ID NO: 278) |
| C7-44 | QVQLQESGPGLVKPSQTLSLTCTVSGGSISSGGYYWSWIRQPPGKGLEWIGYIYYS<br>GSTYYNPSLKSRVTISVDTSKNQFSLKLSSVTAADTAVYYCARERSISPYYYYMDV<br>WGKGTTVTVSSGGGGSGGGGSGGGGSGGDIQMTQSPSSLSASVGDRVTITCRAS<br>QSISSYLNWYQQKPGKAPKLLIYAASSLQSGVPSRFSGSGSGTDFTLTISSLQPEDFA<br>TYYCQQSYSTPLTFGGGTKVEIK (SEQ ID NO: 279) |
| C7-43 | QLQLQESGPGLVKPSETLSLTCTVSGGSISSSSYYWGWIRQPPGKGLEWIGSIYYSG<br>STYYNPSLKSRVTISVDTSKNQFSLKLSSVTAADTAVYYCARDSVIWYWFDPWGQG<br>TLVTVSSGGGGSGGGGSGGGGSGGQSVLTQPPSASGTPGQRVTISCSGSSSNIGS<br>NTVNWYQQLPGTAPKLLIYSNNQRPSGVPDRFSGSKSGTSASLAISGLQSEDEADY<br>YCAAWDDSLNGWVFGGGTKLTVL (SEQ ID NO: 280) |
| C7-42 | QVQLQESGPGLVKPSQTLSLTCTVSGGSISSGGYYWSWIRQPPGKGLEWIGYIYYS<br>GSTYYNPSLKSRVTISVDTSKNQFSLKLSSVTAADTAVYYCAREEILPRLSYYYYMDV<br>WGKGTTVTVSSGGGGSGGGGSGGGGSGGDIQMTQSPSSLSASVGDRVTITCRAS<br>QSISSYLNWYQQKPGKAPKLLIYAASSLQSGVPSRFSGSGSGTDFTLTISSLQPEDFA<br>TYYCQQSYSTPLTFGGGTKVEIK (SEQ ID NO: 281) |

TABLE 5-continued

| HLA scFv binding domains | |
|---|---|
| C7-41 | QVQLVQSGSELKKPGASVKVSCKASGYTFTSYAMNWVRQAPGQGLEWMGWIN TNTGNPTYAQGFTGRFVFSFDTSVSTAYLQICSLKAEDTAVYYCARGGRAHSSWYF DLWGRGTLVTVSSGGGGSGGGGSGGGGSGGDIQMTQSPSSLSASVGDRVTITCR ASQSISSYLNWYQQKPGKAPKLLIYAASSLQSGVPSRFSGSGSGTDFTLTISSLQPED FATYYCQQSYSTPLTFGGGTKVEIK (SEQ ID NO: 282) |
| C7-40 | QVQLQESGPGLVKPSQTLSLTCTVSGGSISSGGYYWSWIRQPPGKGLEWIGYIYYS GSTYYNPSLKSRVTISVDTSKNQFSLKLSSVTAADTAVYYCARDRIKILPRLGYYYYM DVWGKGTTVIVSSGGGGSGGGGSGGGGSGGDIQMTQSPSSLSASVGDRVTITC RASQSISSYLNWYQQKPGKAPKLLIYAASSLQSGVPSRFSGSGSGTDFTLTISSLQPE DFATYYCQQSYSTPLTFGGGTKVEIK (SEQ ID NO: 283) |
| C7-39 | QVQLQESGPGLVKPSQTLSLTCTVSGGSISSGGYYWSWIRQPPGKGLEWIGYIYYS GSTYYNPSLKSRVTISVDTSKNQFSLKLSSVTAADTAVYYCARDTVIHYYYYMDVW GKGTTVTVSSGGGGSGGGGSGGGGSGGDIQMTQSPSSLSASVGDRVTITCRASQ SISSYLNWYQQKPGKAPKLLIYAASSLQSGVPSRFSGSGSGTDFTLTISSLQPEDFAT YYCQQSYSTPLTFGGGTKVEIK (SEQ ID NO: 284) |
| C7-38 | QVQLQESGPGLVKPSQTLSLTCTVSGGSISSGGYYWSWIRQPPGKGLEWIGYIYYS GSTYYNPSLKSRVTISVDTSKNQFSLKLSSVTAADTAVYYCARDVIVEVFLSYYYYMD VWGKGTTVTVSSGGGGSGGGGSGGGGSGGDIQMTQSPSSLSASVGDRVTITCR ASQSISSYLNWYQQKPGKAPKLLIYAASSLQSGVPSRFSGSGSGTDFTLTISSLQPED FATYYCQQSYSTPLTFGGGTKVEIK (SEQ ID NO: 285) |
| C7-37 | QVQLQESGPGLVKPSQTLSLTCTVSGGSISSGGYYWSWIRQPPGKGLEWIGYIYYS GSTYYNPSLKSRVTISVDTSKNQFSLKLSSVTAADTAVYYCARDIF1HYYYYMDVWG KGTTVTVSSGGGGSGGGGSGGGGSGGDIQMTQSPSSLSASVGDRVTITCRASQSI SSYLNWYQQKPGKAPKLLIYAASSLQSGVPSRFSGSGSGTDFTLTISSLQPEDFATYY CQQSYSTPLTFGGGTKVEIK (SEQ ID NO: 286) |
| C7-36 | EVQLVESGGGLVQPGGSLRLSCAASGFTFSSYSMNWVRQAPGKGLEWVSYISSSS STIYYADSVKGRFTISRDNAKNSLYLQMNSLRAEDTAVYYCARDGTFYSYSPYYFDY WGQGTLVTVSSGGGGSGGGGSGGGGSGGDIQMTQSPSSLSASVGDRVTITCRA SQSISSYLNWYQQKPGKAPKLLIYAASSLQSGVPSRFSGSGSGTDFTLTISSLQPEDF ATYYCQQSYSTPLTFGGGTKVEIK (SEQ ID NO: 287) |
| C7-35 | QVQLQESGPGLVKPSQTLSLTCTVSGGSISSGGYYWSWIRQPPGKGLEWIGYIYYS GSTYYNPSLKSRVTISVDTSKNQFSLKLSSVTAADTAVYYCAREWIKILPRLGYYYYM DVWGKGTTVTVSSGGGGSGGGGSGGGGSGGDIQMTQSPSSLSASVGDRVTITC RASQSISSYLNWYQQKPGKAPKLLIYAASSLQSGVPSRFSGSGSGTDFTLTISSLQPE DFATYYCQQSYSTPLTFGGGTKVEIK (SEQ ID NO: 288) |
| C7-34 | QVQLQESGPGLVKPSQTLSLTCTVSGGSISSGGYYWSWIRQPPGKGLEWIGYIYYS GSTYYNPSLKSRVTISVDTSKNQFSLKLSSVTAADTAVYYCARDRSLYYYYYMDVW GKGTTVTVSSGGGGSGGGGSGGGGSGGDIQMTQSPSSLSASVGDRVTITCRASQ SISSYLNWYQQKPGKAPKLLIYAASSLQSGVPSRFSGSGSGTDFTLTISSLQPEDFAT YYCQQSYSTPLTFGGGTKVEIK (SEQ ID NO: 289) |
| C7-33 | QVQLQESGPGLVKPSQTLSLTCTVSGGSISSGGYYWSWIRQPPGKGLEWIGYIYYS GSTYYNPSLKSRVTISVDTSKNQFSLKLSSVTAADTAVYYCARDKILAPNYYYYMDV WGKGTTVTVSSGGGGSGGGGSGGGGSGGDIQMTQSPSSLSASVGDRVTITCRAS QSISSYLNWYQQKPGKAPKLLIYAASSLQSGVPSRFSGSGSGTDFTLTISSLQPEDFA TYYCQQSYSTPLTFGGGTKVEIK (SEQ ID NO: 290) |
| C7-32 | QVQLQESGPGLVKPSQTLSLTCTVSGGSISSGGYYWSWIRQPPGKGLEWIGYIYYS GSTYYNPSLKSRVTISVDTSKNQFSLKLSSVTAADTAVYYCAREKSWKYFYYYYYYM DVWGKGTTVTVSSGGGGSGGGGSGGGGSGGDIQMTQSPSSLSASVGDRVTITC RASQSISSYLNWYQQKPGKAPKLLIYAASSLQSGVPSRFSGSGSGTDFTLTISSLQPE DFATYYCQQSYSTPLTFGGGTKVEIK (SEQ ID NO: 291) |
| C7-31 | QVQLQESGPGLVKPSQTLSLTCTVSGGSISSGGYYWSWIRQPPGKGLEWIGYIYYS GSTYYNPSLKSRVTISVDTSKNQFSLKLSSVTAADTAVYYCARENTSTIPYYYYYMDV WGKGTTVTVSSGGGGSGGGGSGGGGSGGDIQMTQSPSSLSASVGDRVTITCRAS QSISSYLNWYQQKPGKAPKLLIYAASSLQSGVPSRFSGSGSGTDFTLTISSLQPEDFA TYYCQQSYSTPLTFGGGTKVEIK (SEQ ID NO: 292) |
| C7-30 | QVQLQESGPGLVKPSQTLSLTCTVSGGSISSGGYYWSWIRQPPGKGLEWIGYIYYS GSTYYNPSLKSRVTISVDTSKNQFSLKLSSVTAADTAVYYCAREDVDKNTSTIYYYYY YMDVWGKGTTVTVSSGGGGSGGGGSGGGGSGGDIQMTQSPSSLSASVGDRVTI TCRASQSISSYLNWYQQKPGKAPKLLIYAASSLQSGVPSRFSGSGSGTDFTLTISSLQ PEDFATYYCQQSYSTPLTFGGGTKVEIK (SEQ ID NO: 293) |
| C7-29 | QVQLVESGGGLVKPGGSLRLSCAASGFTFSDYYMSWIRQAPGKGLEWVSYISSSG STIYYADSVKGRFTISRDNAKNSLYLQMNSLRAEDTAVYYCARDGGIVSSSAIYWY FDLWGRGTLVTVSSGGGGSGGGGSGGGGSGGAIQLTQSPSSLSASVGDRVTITCR ASQGISSALAWYQQKPGKAPKLLIYDASSLESGVPSRFSGSGSGTDFTLTISSLQPED FATYYCQQFNSYPLTFGGGTKVEIK (SEQ ID NO: 294) |

TABLE 5-continued

| HLA scFv binding domains | |
|---|---|
| C7-28 | QVQLQESGPGLVKPSQTLSLTCTVSGGSISSGGYYWSWIRQPPGKGLEWIGYIYYS GSTYYNPSLKSRVTISVDTSKNQFSLKLSSVTAADTAVYYCARDLILPPYYYYYMDV WGKGTTVTVSSGGGGSGGGGSGGGGSGGDIQMTQSPSSLSASVGDRVTITCRAS QSISSYLNWYQQKPGKAPKLLIYAASSLQSGVPSRFSGSGSGTDFTLTISSLQPEDFA TYYCQQSYSTPLTFGGGTKVEIK (SEQ ID NO: 295) |
| C7-27 | QVQLQESGPGLVKPSQTLSLTCTVSGGSISSGGYYWSWIRQPPGKGLEWIGYIYYS GSTYYNPSLKSRVTISVDTSKNQFSLKLSSVTAADTAVYYCARETWIKILPRYYYYYY MDVWGKGTTVTVSSGGGGSGGGGSGGGGSGGDIQMTQSPSSLSASVGDRVTIT CRASQSISSYLNWYQQKPGKAPKLLIYAASSLQSGVPSRFSGSGSGTDFTLTISSLQP EDFATYYCQQSYSTPLTFGGGTKVEIK (SEQ ID NO: 296) |
| C7-26 | QVQLQESGPGLVKPSQTLSLTCTVSGGSISSGGYYWSWIRQPPGKGLEWIGYIYYS GSTYYNPSLKSRVTISVDTSKNQFSLKLSSVTAADTAVYYCARDLSRYYYYYMDVW GKGTTVTVSSGGGGSGGGGSGGGGSGGDIQMTQSPSSLSASVGDRVTITCRASQ SISSYLNWYQQKPGKAPKLLIYAASSLQSGVPSRFSGSGSGTDFTLTISSLQPEDFAT YYCQQSYSTPLTFGGGTKVEIK (SEQ ID NO: 297) |
| C7-25 | EVQLVESGGGLVQPGGSLRLSCAASGFTFSSYSMNWVRQAPGKGLEWVSYISSS STIYYADSVKGRFTISRDNAKNSLYLQMNSLRAEDTAVYYCAREHIVLCFDYWGQG TLVTVSSGGGGSGGGGSGGGGSGGDIQMTQSPSSLSASVGDRVTITCRASQGISS WLAWYQQKPEKAPKSLIYAASSLQSGVPSRFSGSGSGTDFTLTISSLQPEDFATYYC QQYNSYPLTFGGGTKVEIK (SEQ ID NO: 298) |
| C7-24 | QVQLQESGPGLVKPSQTLSLTCTVSGGSISSGGYYWSWIRQPPGKGLEWIGYIYYS GSTYYNPSLKSRVTISVDTSKNQFSLKLSSVTAADTAVYYCARDKILPRPYYYYYMDV WGKGTTVTVSSGGGGSGGGGSGGGGSGGDIQMTQSPSSLSASVGDRVTITCRAS QSISSYLNWYQQKPGKAPKLLIYAASSLQSGVPSRFSGSGSGTDFTLTISSLQPEDFA TYYCQQSYSTPLTFGGGTKVEIK (SEQ ID NO: 299) |
| C7-23 | QVQLVQSGAEVKKPGASVKVSCKASGYTFTSYGISWVRQAPGQGLEWMGWISA YNGNTNYAQKLQGRVTMTTDTSTSTAYMELRSLRSDDTAVYYCARGSNEYFQHW GQGTLVTVSSGGGGSGGGGSGGGGSGGQSALTQPPSASGSPGQSVTISCTGTSS DVGGYNYVSWYQQHPGKAPKLMIYEVSKRPSGVPDRFSGSKSGNTASLTVSGLQ AEDEADYYCSSYAGSNNWVFGGGTKLTVL (SEQ ID NO: 300) |
| C7-22 | QVQLVQSGSELKKPGASVKVSCKASGYTFTSYAMNWVRQAPGQGLEWMGWIN TNTGNPTYAQGFTGRFVFSFDTSVSTAYLQICSLKAEDTAVYYCARGTSYWYFDLW GRGTLVTVSSGGGGSGGGGSGGGGSGGDIQMTQSPSSLSASVGDRVTITCRASQ SISSYLNWYQQKPGKAPKLLIYAASSLQSGVPSRFSGSGSGTDFTLTISSLQPEDFAT YYCQQSYSTPLTFGGGTKVEIK (SEQ ID NO: 301) |
| C7-21 | QVQLQESGPGLVKPSQTLSLTCTVSGGSISSGGYYWSWIRQPPGKGLEWIGYIYYS GSTYYNPSLKSRVTISVDTSKNQFSLKLSSVTAADTAVYYCAREEIVEVFYYYYMDV WGKGTTVTVSSGGGGSGGGGSGGGGSGGDIQMTQSPSSLSASVGDRVTITCRAS QSISSYLNWYQQKPGKAPKLLIYAASSLQSGVPSRFSGSGSGTDFTLTISSLQPEDFA TYYCQQSYSTPLTFGGGTKVEIK (SEQ ID NO: 302) |
| C7-20 | EVQLLESGGGLVQPGGSLRLSCAASGFTFSSYAMSWVRQAPGKGLEWVSAISGSG GSTYYADSVKGRFTISRDNSKNTLYLQMNSLRAEDTAVYYCAKVDDYYFDYWGQG TLVTVSSGGGGSGGGGSGGGGSGGDIQMTQSPSSLSASVGDRVTITCRASQSISSY LNWYQQKPGKAPKLLIYAASSLQSGVPSRFSGSGSGTDFTLTISSLQPEDFATYYCQ QSYSTPLTFGGGTKVEIK (SEQ ID NO: 303) |
| C7-19 | EVQLVESGGGLVQPGGSLRLSCAASGFTFSSYWMHWVRQAPGKGLVWVSRINS DGSSTSYADSVKGRFTISRDNAKNTLYLQMNSLRAEDTAVYYCAWSTNILLSYTKA FDIWGQGTMVTVSSGGGGSGGGGSGGGGSGGDIQMTQSPSSLSASVGDRVTIT CRASQSISSYLNWYQQKPGKAPKLLIYAASSLQSGVPSRFSGSGSGTDFTLTISSLQP EDFATYYCQQSYSTPLTFGGGTKVEIK (SEQ ID NO: 304) |
| C7-18 | QVQLQESGPGLVKPSQTLSLTCTVSGGSISSGGYYWSWIRQPPGKGLEWIGYIYYS GSTYYNPSLKSRVTISVDTSKNQFSLKLSSVTAADTAVYYCARDKTYYYYYYMDVW GKGTTVTVSSGGGGSGGGGSGGGGSGGDIQMTQSPSSLSASVGDRVTITCRASQ SISSYLNWYQQKPGKAPKLLIYAASSLQSGVPSRFSGSGSGTDFTLTISSLQPEDFAT YYCQQSYSTPLTFGGGTKVEIK (SEQ ID NO: 305) |
| C7-17 | QVQLQESGPGLVKPSQTLSLTCTVSGGSISSGGYYWSWIRQPPGKGLEWIGYIYYS GSTYYNPSLKSRVTISVDTSKNQFSLKLSSVTAADTAVYYCAREKYFHDKYFHDYYYY YMDVWGKGTTVTVSSGGGGSGGGGSGGGGSGGDIQMTQSPSSLSASVGDRVTI TCRASQSISSYLNWYQQKPGKAPKLLIYAASSLQSGVPSRFSGSGSGTDFTLTISSLQ PEDFATYYCQQSYSTPLTFGGGTKVEIK (SEQ ID NO: 306) |
| C7-16 | QVQLQESGPGLVKPSQTLSLTCTVSGGSISSGGYYWSWIRQPPGKGLEWIGYIYYS GSTYYNPSLKSRVTISVDTSKNQFSLKLSSVTAADTAVYYCARDTSVYYYYYMDVW GKGTTVTVSSGGGGSGGGGSGGGGSGGDIQMTQSPSSLSASVGDRVTITCRASQ SISSYLNWYQQKPGKAPKLLIYAASSLQSGVPSRFSGSGSGTDFTLTISSLQPEDFAT YYCQQSYSTPLTFGGGTKVEIK (SEQ ID NO: 307) |

TABLE 5-continued

| HLA scFv binding domains |
|---|

C7-15
QVQLQESGPGLVKPSQTLSLTCTVSGGSISSGGYYWSWIRQPPGKGLEWIGYIYYS
GSTYYNPSLKSRVTISVDTSKNQFSLKLSSVTAADTAVYYCAREKILPYYYYYMDV
WGKGTTVTVSSGGGGSGGGGSGGGGSGGDIQMTQSPSSLSASVGDRVTITCRAS
QSISSYLNWYQQKPGKAPKLLIYAASSLQSGVPSRFSGSGSGTDFTLTISSLQPEDFA
TYYCQQSYSTPLTFGGGTKVEIK (SEQ ID NO: 308)

C7-14
EVQLVESGGGLVQPGGSLRLSCAASGFTFSSYSMNWVRQAPGKGLEWVSYISSSS
STIYYADSVKGRFTISRDNAKNSLYLQMNSLRAEDTAVYYCAIQWIYIYINPRGFIFL
HDAFDIWGQGTMVTVSSGGGGSGGGGSGGGGSGGQSVLTQPPSASGTPGQRV
TISCSGSSSNIGSNTVNWYQQLPGTAPKLLIYSNNQRPSGVPDRFSGSKSGTSASLA
ISGLQSEDEADYYCAAWDDSLNGWVFGGGTKLTVL (SEQ ID NO: 309)

C7-13
QVQLQQSGPGLVKPSQTLSLTCAISGDSVSSNSAAWNWIRQSPSRGLEWLGRTYY
RSKWYNDYAVSVKSRITINPDTSKNQFSLQLNSVTPEDTAVYYCAKEDVDFHHDAF
DIWGQGTMVTVSSGGGGSGGGGSGGGGSGGDIQMTQSPSSLSASVGDRVTITC
RASQSISSYLNWYQQKPGKAPKLLIYAASSLQSGVPSRFSGSGSGTDFTLTISSLQPE
DFATYYCQQSYSTPLTFGGGTKVEIK (SEQ ID NO: 310)

C7-12
QVQLQESGPGLVKPSQTLSLTCTVSGGSISSGGYYWSWIRQPPGKGLEWIGYIYYS
GSTYYNPSLKSRVTISVDTSKNQFSLKLSSVTAADTAVYYCAREGVDKNTSTIYYYYY
YMDVWGKGTTVTVSSGGGGSGGGGSGGGGSGGDIQMTQSPSSLSASVGDRVTI
TCRASQSISSYLNWYQQKPGKAPKLLIYAASSLQSGVPSRFSGSGSGTDFTLTISSLQ
PEDFATYYCQQSYSTPLTFGGGTKVEIK (SEQ ID NO: 311)

C7-11
EVQLVESGGGLVQPGGSLRLSCAASGFTFSSYSMNWVRQAPGKGLEWVSYISSSS
STIYYADSVKGRFTISRDNAKNSLYLQMNSLRAEDTAVYYCARDRRGYFDLWGRG
TLVTVSSGGGGSGGGGSGGGGSGGDIQMTQSPSSLSASVGDRVTITCRASQGISS
WLAWYQQKPEKAPKSLIYAASSLQSGVPSRFSGSGSGTDFTLTISSLQPEDFATYYC
QQYNSYPLTFGGGTKVEIK (SEQ ID NO: 312)

C7-10
EVQLVQSGAEVKKPGATVKISCKVSGYTFTDYYMHWVQQAPGKGLEWMGLVDP
EDGETIYAEKFQGRVTITADTSTDTAYMELSSLRSEDTAVYYCATGIHVDIRSMED
WFDPWGQGTLVTVSSGGGGSGGGGSGGGGSGGDIQMTQSPSSLSASVGDRVTI
TCRASQSISSYLNWYQQKPGKAPKLLIYAASSLQSGVPSRFSGSGSGTDFTLTISSLQ
PEDFATYYCQQSYSTPLTFGGGTKVEIK (SEQ ID NO: 313)

C7-9
QVQLQESGPGLVKPSQTLSLTCTVSGGSISSGGYYWSWIRQPPGKGLEWIGYIYYS
GSTYYNPSLKSRVTISVDTSKNQFSLKLSSVTAADTAVYYCARDIGTSYYYYMDVW
GKGTTVTVSSGGGGSGGGGSGGGGSGGDIQMTQSPSSLSASVGDRVTITCRASQ
SISSYLNWYQQKPGKAPKLLIYAASSLQSGVPSRFSGSGSGTDFTLTISSLQPEDFAT
YYCQQSYSTPLTFGGGTKVEIK (SEQ ID NO: 314)

C7-8
QVQLQESGPGLVKPSQTLSLTCTVSGGSISSGGYYWSWIRQPPGKGLEWIGYIYYS
GSTYYNPSLKSRVTISVDTSKNQFSLKLSSVTAADTAVYYCAREVVEVFLYYYYMD
VWGKGTTVTVSSGGGGSGGGGSGGGGSGGDIQMTQSPSSLSASVGDRVTITCR
ASQSISSYLNWYQQKPGKAPKLLIYAASSLQSGVPSRFSGSGSGTDFTLTISSLQPED
FATYYCQQSYSTPLTFGGGTKVEIK (SEQ ID NO: 315)

C7-7
QVQLQESGPGLVKPSQTLSLTCTVSGGSISSGGYYWSWIRQPPGKGLEWIGYIYYS
GSTYYNPSLKSRVTISVDTSKNQFSLKLSSVTAADTAVYYCARDLYYYYYYMDVW
GKGTTVTVSSGGGGSGGGGSGGGGSGGDIQMTQSPSSLSASVGDRVTITCRASQ
SISSYLNWYQQKPGKAPKLLIYAASSLQSGVPSRFSGSGSGTDFTLTISSLQPEDFAT
YYCQQSYSTPLTFGGGTKVEIK (SEQ ID NO: 316)

C7-6
QVQLQESGPGLVKPSQTLSLTCTVSGGSISSGGYYWSWIRQPPGKGLEWIGYIYYS
GSTYYNPSLKSRVTISVDTSKNQFSLKLSSVTAADTAVYYCARESWKYFYPRGS1F1H
YYYYMDVWGKGTTVTVSSGGGGSGGGGSGGGGSGGDIQMTQSPSSLSASVGD
RVTITCRASQSISSYLNWYQQKPGKAPKLLIYAASSLQSGVPSRFSGSGSGTDFTLTI
SSLQPEDFATYYCQQSYSTPLTFGGGTKVEIK (SEQ ID NO: 317)

C7-5
QVQLQESGPGLVKPSQTLSLTCTVSGGSISSGGYYWSWIRQPPGKGLEWIGYIYYS
GSTYYNPSLKSRVTISVDTSKNQFSLKLSSVTAADTAVYYCARDRIVEVFYYYYMDV
WGKGTTVTVSSGGGGSGGGGSGGGGSGGDIQMTQSPSSLSASVGDRVTITCRAS
QSISSYLNWYQQKPGKAPKLLIYAASSLQSGVPSRFSGSGSGTDFTLTISSLQPEDFA
TYYCQQSYSTPLTFGGGTKVEIK (SEQ ID NO: 318)

C7-4
QVQLQESGPGLVKPSQTLSLTCTVSGGSISSGGYYWSWIRQPPGKGLEWIGYIYYS
GSTYYNPSLKSRVTISVDTSKNQFSLKLSSVTAADTAVYYCAREKYFHDWLYYYYYM
DVWGKGTTVIVSSGGGGSGGGGSGGGGSGGDIQMTQSPSSLSASVGDRVTITC
RASQSISSYLNWYQQKPGKAPKLLIYAASSLQSGVPSRFSGSGSGTDFTLTISSLQPE
DFATYYCQQSYSTPLTFGGGTKVEIK (SEQ ID NO: 319)

C7-3
QVQLQESGPGLVKPSQTLSLTCTVSGGSISSGGYYWSWIRQPPGKGLEWIGYIYYS
GSTYYNPSLKSRVTISVDTSKNQFSLKLSSVTAADTAVYYCARDLVDKNTSYYYYYM
DVWGKGTTVIVSSGGGGSGGGGSGGGGSGGDIQMTQSPSSLSASVGDRVTITC
RASQSISSYLNWYQQKPGKAPKLLIYAASSLQSGVPSRFSGSGSGTDFTLTISSLQPE
DFATYYCQQSYSTPLTFGGGTKVEIK (SEQ ID NO: 320)

TABLE 5-continued

HLA scFv binding domains

C7-2
QVQLVQSGAEVKKPGASVKVSCKASGYTFTSYGISWVRQAPGQGLEWMGWISA
YNGNTNYAQKLQGRVTMTTDTSTSTAYMELRSLRSDDTAVYYCARVQNEYFQH
WGQGTLVTVSSGGGGSGGGGSGGGGSGGQSALTQPPSASGSPGQSVTISCTGTS
SDVGGYNYVSWYQQHPGKAPKLMIYEVSKRPSGVPDRFSGSKSGNTASLTVSGLQ
AEDEADYYCSSYAGSNNWVFGGGTKLTVL (SEQ ID NO: 321)

C7-1
QVQLVESGGGLVKPGGSLRLSCAASGFTFSDYYMSWIRQAPGKGLEWVSYISSSG
STIYYADSVKGRFTISRDNAKNSLYLQMNSLRAEDTAVYYCATANWFDPWGQGTL
VTVSSGGGGSGGGGSGGGGSGGDIQMTQSPSSVSASVGDRVTITCRASQGISSW
LAWYQQKPGKAPKLLIYAASSLQSGVPSRFSGSGSGTDFTLTISSLQPEDFATYYCQ
QANSFPLTFGGGTKVEIK (SEQ ID NO: 322)

HLA-A*03 scFv Sequences

15
QVQLVQSGAEVKKPGASVKVSCKASGYTFTSYGISWVRQAP
GQGLEWMGWISAYNGNTNYAQKLQGRVTMTTDTSTSTAY
MELRSLRSDDTAVYYCARERVSQRGAFDIWGQGTMVTVSS
GGGGSGGGGSGGGGSGGDIQMTQSPSSLSASVGDRVTITCR
ASQSISSYLNWYQQKPGKAPKLLIYAASSLQSGVPSRFSGSGS
GTDFTLTISSLQPEDFATYYCQQSYSTPLTFGGGTKVEIK
(SEQ ID NO: 323)

16
EVQLVESGGGLVQPGGSLRLSCAASGFTFSSYSMNWVRQAP
GKGLEWVSYISSSSSTIYYADSVKGRFTISRDNAKNSLYLQM
NSLRAEDTAVYYCARGNPDKDPFDYWGQGTLVTVSSGGGG
SGGGGSGGGGSGGDIQMTQSPSSLSASVGDRVTITCRASQSIS
SYLNWYQQKPGKAPKLLIYAASSLQSGVPSRFSGSGSGTDFT
LTISSLQPEDFATYYCQQSYSTPLTFGGGTKVEIK (SEQ ID
NO: 324)

17
QVQLQESGPGLVKPSETLSLTCTVSGGSVSSGSYYWSWIRQP
PGKGLEWIGYIYYSGSTNYNPSLKSRVTISVDTSKNQFSLKLS
SVTAADTAVYYCARDFYCTNWYFDLWGRGTLVTVSSGGGG
SGGGGSGGGGSGGDIQMTQSPSSLSASVGDRVTITCRASQSIS
SYLNWYQQKPGKAPKLLIYAASSLQSGVPSRFSGSGSGTDFT
LTISSLQPEDFATYYCQQSYSTPLTFGGGTKVEIK (SEQ ID
NO: 325)

18
QVQLQESGPGLVKPSETLSLTCTVSGGSISSYYWSWIRQPPG
KGLEWIGYIYYSGSTNYNPSLKSRVTISVDTSKNQFSLKLSSV
TAADTAVYYCARESSSGSYWYFDLWGRGTLVTVSSGGGGS
GGGGSGGGGSGGDIQMTQSPSSLSASVGDRVTITCRASQSISS
YLNWYQQKPGKAPKLLIYAASSLQSGVPSRFSGSGSGTDFTL
TISSLQPEDFATYYCQQSYSTPLTFGGGTKVEIK (SEQ ID NO:
326)

19
EVQLVQSGAEVKKPGESLKISCKGSGYSFTSYWIGWVRQMP
GKGLEWMGIIYPGDSDTRYSPSFQGQVTISADKSITAYLQW
SSLKASDTAMYYCARDSGYKYNLYYYYYMDVWGKGTTV
TVSSGGGGSGGGGSGGGGSGGDIQMTQSPSSLSASVGDRVTI
TCRASQSISSYLNWYQQKPGKAPKLLIYAASSLQSGVPSRFS
GSGSGTDFTLTISSLQPEDFATYYCQQSYSTPLTFGGGTKVEI
K (SEQ ID NO: 327)

20
QVQLVQSGAEVKKPGASVKVSCKASGYTFTSYGISWVRQAP
GQGLEWMGWISAYNGNTNYAQKLQGRVTMTTDTSTSTAY
MELRSLRSDDTAVYYCARGGDLSHYYYYMDVWGKGTTVT
VSSGGGGSGGGGSGGGGSGGQTVVTQEPSLTVSPGGTVTLT
CASSTGAVTSGYYPNWFQQKPGQAPRALIYSTSNKHSWTPA
RFSGSLLGGKAALTLSGVQPEDEAEYYCLLYYGGAQWVFG
GGTKLTVL (SEQ ID NO: 328)

21
QVQLVQSGAEVKKPGASVKVSCKASGYTFTSYGISWVRQAP
GQGLEWMGWISAYNGNTNYAQKLQGRVTMTTDTSTSTAY
MELRSLRSDDTAVYYCARENRRYNSCYYFDYWGQGTLVTV
SSGGGGSGGGGSGGGGSGGDIQMTQSPSSLSASVGDRVTITC
RASQSISSYLNWYQQKPGKAPKLLIYAASSLQSGVPSRFSGS
GSGTDFTLTISSLQPEDFATYYCQQSYSTPLTFGGGTKVEIK
(SEQ ID NO: 329)

22
QVQLVQSGAEVKKPGASVKVSCKASGYTFTSYGISWVRQAP
GQGLEWMGWISAYNGNTNYAQKLQGRVTMTTDTSTSTAY
MELRSLRSDDTAVYYCARGGDLSHYYYYLDVWGKGTTVTV
SSGGGGSGGGGSGGGGSGGQTVVTQEPSLTVSPGGTVTLTC
ASSTGAVTSGYYPNWFQQKPGQAPRALIYSTSNKHSWTPAR
FSGSLLGGKAALTLSGVQPEDEAEYYCLLYYGGAQWVFGG
GTKLTVL (SEQ ID NO: 330)

TABLE 5-continued

| HLA scFv binding domains | |
|---|---|
| 23 | EVQLVESGGGLVQPGGSLRLSCAASGFTVSSNYMSWVRQAP GKGLEWVSVIYSGGSTYYADSVKGRFTISRDNSKNTLYLQM NSLRAEDTAVYYCARATLLSLSYDAFDIWGQGTMVTVSSGG GGSGGGGSGGGGSGGDIQMTQSPSSLSASVGDRVTITCRASQ SISSYLNWYQQKPGKAPKLLIYAASSLQSGVPSRFSGSGSGTD FTLTISSLQPEDFATYYCQQSYSTPLTFGGGTKVEIK (SEQ ID NO: 331) |
| 24 | QVQLVQSGAEVKKPGASVKVSCKASGYTFTSYGISWVRQAP GQGLEWMGWISAYNGNTNYAQKLQGRVTMTTDTSTSTAY MELRSLRSDDTAVYYCARGGDLSHYYYMDVWGKGTTVTV SSGGGGSGGGGSGGGGSGGQTVVTQEPSLTVSPGGTVTLTC ASSTGAVTSGYYPNWFQQKPGQAPRALIYSTSNKHSWTPAR FSGSLLGGKAALTLSGVQPEDEAEYYCLLYYGGAQWVFGG GTKLTVL (SEQ ID NO: 332) |
| 25 | EVQLVQSGAEVKKPGESLKISCKGSGYSFTSYWIGWVRQMP GKGLEWMGIIYPGDSDTRYSPSFQGQVTISADKSISTAYLQW SSLKASDTAMYYCARERDRWFDPWGQGTLVTVSSGGGGSG GGGSGGGGSGGDIQMTQSPSSLSASVGDRVTITCRASQSISSY LNWYQQKPGKAPKLLIYAASSLQSGVPSRFSGSGSGTDFTLTI SSLQPEDFATYYCQQSYSTPLTFGGGTKVEIK (SEQ ID NO: 333) |
| 26 | QVQLVQSGAEVKKPGASVKVSCKASGYTFTSYGISWVRQAP GQGLEWMGWISAYNGNTNYAQKLQGRVTMTTDTSTSTAY MELRSLRSDDTAVYYCARETPPSLGAFDIWGQGTMVTVSSG GGGSGGGGSGGGGSGGQSALTQPPSASGSPGQSVTISCTGTS SDVGGYNYVSWYQQHPGKAPKLMIYEVSKRPSGVPDRFSGS KSGNTASLTVSGLQAEDEADYYCSSYAGSNNWVFGGGTKL TVL(SEQ ID NO: 334) |
| 27 | QLQLQESGPGLVKPSETLSLTCTVSGGSISSSSYYWGWIRQPP GKGLEWIGSIYYSGSTYYNPSLKSRVTISVDTSKNQFSLKLSS VTAADTAVYYCAREAYCLSDSYWYFDLWGRGTLVTVSSGG GGSGGGGSGGGGSGGQSVLTQPPSASGTPGQRVTISCSGSSS NIGSNTVNWYQQLPGTAPKLLIYSNNQRPSGVPDRFSGSKSG TSASLAISGLQSEDEADYYCAAWDDSLNGWVFGGGTKLTVL (SEQ ID NO: 335) |
| 28 | QVQLQESGPGLVKPSQTLSLTCTVSGGSISSGGYYWSWIRQP PGKGLEWIGYIYYSGSTYYNPSLKSRVTISVDTSKNQFSLKLS SVTAADTAVYYCARESWKYFYPRGYMDVWGKGTTVTVSS GGGGSGGGGSGGGGSGGDIQMTQSPSSLSASVGDRVTITCR ASQSISSYLNWYQQKPGKAPKLLIYAASSLQSGVPSRFSGSGS GTDFTLTISSLQPEDFATYYCQQSYSTPLTFGGGTKVEIK (SEQ ID NO: 336) |
| HLA-A*01 scFv Sequences | |
| A1-9 | QVQLVQSGAEVKKPGASVKVSCKASGYTFTSYGISWVRQAP GQGLEWMGWISAYNGNTNYAQKLQGRVTMTTDTSTSTAY MELRSLRSDDTAVYYCARGGWTAWYYYMDVWGKGTTVT VSSGGGGSGGGGSGGGGSGGQTVVTQEPSLTVSPGGTVTLT CASSTGAVTSGYYPNWFQQKPGQAPRALIYSTSNKHSWTPA RFSGSLLGGKAALTLSGVQPEDEAEYYCLLYYGGAQWVFG GGTKLTVL (SEQ ID NO: 337) |
| A1-8 | EVQLVESGGGLVQPGGSLRLSCAASGFTFSSYSMNWVRQAP GKGLEWVSYISSSSTIYYADSVKGRFTISRDNAKNSLYLQM NSLRAEDTAVYYCARAKYYYMDWGKGTTVTVSSGGGGS GGGGSGGGGSGGQSVLTQPPSASGTPGQRVTISCSGSSSNIGS NTVNWYQQLPGTAPKLLIYSNNQRPSGVPDRFSGSKSGTSAS LAISGLQSEDEADYYCAAWDDSLNGWVFGGGTKLTVL (SEQ ID NO: 338) |
| A1-7 | QVQLQESGPGLVKPSQTLSLTCTVSGGSISSGGYYWSWIRQP PGKGLEWIGYIYYSGSTYYNPSLKSRVTISVDTSKNQFSLKLS SVTAADTAVYYCARDQVDKNTYYYMDVWGKGTTVTVSS GGGGSGGGGSGGGGSGGDIQMTQSPSSLSASVGDRVTITCR ASQSISSYLNWYQQKPGKAPKLLIYAASSLQSGVPSRFSGSGS GTDFTLTISSLQPEDFATYYCQQSYSTPLTFGGGTKVEIK (SEQ ID NO: 339) |

TABLE 5-continued

HLA scFv binding domains

| | |
|---|---|
| A1-6 | QVQLVESGGGLVKPGGSLRLSCAASGFTFSDYYMSWIRQAP GKGLEWVSYISSSGSTIYYADSVKGRFTISRDNAKNSLYLQM NSLRAEDTAVYYCARACQLAEYFQHWGQGTLVTVSSGGGG SGGGGSGGGGSGGDIQMTQSPSSVSASVGDRVTITCRASQGI SSWLAWYQQKPGKAPKLLIYAASSLQSGVPSRFSGSGSGTDF TLTISSLQPEDFATYYCQQANSFPLTFGGGTKVEIK (SEQ ID NO: 340) |
| A1-5 | QVQLQESGPGLVKPSQTLSLTCTVSGGSISSGGYYWSWIRQP PGKGLEWIGYIYYSGSTYYNPSLKSRVTISVDTSKNQFSLKLS SVTAADTAVYYCARDRVDKNTSYYYMDVWGKGTTVTVSS GGGGSGGGGSGGGGSGGDIQMTQSPSSLSASVGDRVTITCR ASQSISSYLNWYQQKPGKAPKLLIYAASSLQSGVPSRFSGSGS GTDFTLTISSLQPEDFATYYCQQSYSTPLTFGGGTKVEIK (SEQ ID NO: 341) |
| A1-4 | QVQLQESGPGLVKPSDTLSLTCAVSGYSISSSNWWGWIRQPP GKGLEWIGYIYYSGSTYYNPSLKSRVTMSVDTSKNQFSLKLS SVTAVDTAVYYCARRVQLKLVHWFDPWGQGTLVTVSSGGG GSGGGGSGGGGSGGDIQMTQSPSSLSASVGDRVTITCRASQS ISSYLNWYQQKPGKAPKLLIYAASSLQSGVPSRFSGSGSGTDF TLTISSLQPEDFATYYCQQSYSTPLTFGGGTKVEIK (SEQ ID NO: 342) |
| A1-3 | QVQLVQSGAEVKKPGASVKVSCKASGYTFTSYDINWVRQA TGQGLEWMGWMNPNSGNTGYAQKFQGRVTMTRNTSISTA YMELSSLRSEDTAVYYCATYYDYVTVFYFQHWGQGTLVTV SSGGGGSGGGGSGGGGSGGDIQMTQSPSSLSASVGDRVTITC RASQSISSYLNWYQQKPGKAPKLLIYAASSLQSGVPSRFSGS GSGTDFTLTISSLQPEDFATYYCQQSYSTPLTFGGGTKVEIK (SEQ ID NO: 343) |
| A1-2 | QLQLQESGSGLVKPSQTLSLTCAVSGGSISSGGYSWSWIRQPP GKGLEWIGYIYHSGSTYYNPSLKSRVTISVDRSKNQFSLKLSS VTAADTAVYYCARESYPSFYAFDIWGQGTMVTVSSGGGGS GGGGSGGGGSGGDIQMTQSPSSLSASVGDRVTITCRASQSISS YLNWYQQKPGKAPKLLIYAASSLQSGVPSRFSGSGSGTDFTL TISSLQPEDFATYYCQQSYSTPLTFGGGTKVEIK (SEQ ID NO: 344) |
| A1-1 | QITLKESGPTLVKPTQTLTLTCTFSGFSLSTSGVGVGWIRQPP GKALEWLALIYWNDDKRYSPSLKSRLTITKDTSKNQVVLTM TNMDPVDTATYYCAHSNMWSYSLNDYYFDYWGQGTLVTV SSGGGGSGGGGSGGGGSGGDIQMTQSPSSLSASVGDRVTITC RASQSISSYLNWYQQKPGKAPKLLIYAASSLQSGVPSRFSGS GSGTDFTLTISSLQPEDFATYYCQQSYSTPLTFGGGTKVEIK (SEQ ID NO: 345) |

In some embodiments, the ligand binding domain of the second, inhibitory receptor comprises an scFv. In some embodiments, the scFv binds to HLA-A*01, HLA-A*02, HLA-A*3, HLA-A*11, HLA-B*07 or HLA-C*07, and comprises a sequence selected from the SEQ ID NOS: 91-102, 250-260, 262, 264, 266, 268, 270, 272, 274, 276, and 278-345, or the group of sequences set forth in Table 5, or a sequence having at least 80%, at least 85%, at least 90%, at least 95%, at least 97% or at least 99% identity thereto. In some embodiments, the scFv binds to HLA-A*01, HLA-A*02, HLA-A*3, HLA-A*11, HLA-B*07 or HLA-C*07, and comprises a sequence selected from the group of sequences set forth in Table 5. In some embodiments, the non-target antigen comprises HLA-A*01, and the non-target extracellular ligand binding domain of the second receptor comprises an HLA-A*01 scFv sequence comprising SEQ ID NOS: 337-345 as set forth in Table 5, or a sequence having at least 80%, at least 85%, at least 90%, at least 95%, at least 97% or at least 99% identity thereto. In some embodiments, the non-target antigen comprises HLA-A*02, and the non-target extracellular ligand binding domain of the second receptor comprises an HLA-A*02 scFv sequence comprising SEQ ID NOS: 91-102 as set forth in Table 5, or a sequence having at least 80%, at least 85%, at least 90%, at least 95%, at least 97% or at least 99% identity thereto. In some embodiments, the non-target antigen comprises HLA-A*03, and the non-target extracellular ligand binding domain of the second receptor comprises an HLA-A*03 scFv sequence comprising SEQ ID NOS: 323-336 as set forth in Table 5, or a sequence having at least 80%, at least 85%, at least 90%, at least 95%, at least 97% or at least 99% identity thereto. In some embodiments, the non-target antigen comprises HLA-A*11, and the non-target extracellular ligand binding domain of the second receptor comprises an HLA-A*11 scFv sequence comprising SEQ ID NOS: 260, 262, 264, 266, 268, 270, 272, 274 or 276 as set forth in Table 5, or a sequence having at least 80%, at least 85%, at least 90%, at least 95%, at least 97% or at least 99% identity thereto. In some embodiments, the non-target antigen comprises HLA-B*07, and the non-target extracellular ligand binding domain of the second receptor comprises an HLA-B*07 scFv sequence comprising SEQ ID NOS: 250-259 as set forth in Table 5, or a sequence having at least 80%, at least 85%, at least 90%, at least 95%, at least 97% or at least 99% identity thereto. In some embodiments, the non-target antigen comprises HLA-C*07, and the non-target extracellular ligand binding domain of the second receptor comprises an HLA-C*07 scFv sequence comprising SEQ ID NOS: 278-322 as set forth in Table 5, or a sequence having at least 80%, at least 85%, at least 90%, at least 95%, at least 97% or at least 99% identity thereto.

Exemplary heavy chain and light chain CDRs (CDR-H1, CDR-H2 and CDR-H3, or CDR-L1, CDR-L2 and CDR-L3, respectively) for HLA-A*01, HLA-A*02, HLA-A*03, HLA-A*11, HLA-B*07 and HLA-C*07 ligand binding domains are shown in table 6 below.

TABLE 6

CDRs corresponding to HLA antigen binding domains

| CDR-L1 | CDR-L2 | CDR-L3 | CDR-H1 | CDR-H2 | CDR-H3 |
|---|---|---|---|---|---|
| RSSQSIVHSNGNTYLE (SEQ ID NO: 103) | KVSNRFSGVPDR (SEQ ID NO: 104) | FQGSHVPRT (SEQ ID NO: 105) | ASGYTFTSYHIH (SEQ ID NO: 106) | WIYPGNVNTEYNEKFKGK (SEQ ID NO: 107) | EEITYAMDY (SEQ ID NO: 108) |
| RSSQSIVHSNGNTYLD (SEQ ID NO: 109) | KVSNRFSGVPDR (SEQ ID NO: 110) | MQGSHVPRT (SEQ ID NO: 111) | SGYTFTSYHMH (SEQ ID NO: 112) | WIYPGDGSTQYNEKFKG (SEQ ID NO: 113) | EGTYYAMDY (SEQ ID NO: 114) |
| HLA-A*03 CDRs | | | | | |
| RASQSISSYLN (SEQ ID NO: 346) | AASSLQS (SEQ ID NO: 353) | QQSYSTPLT (SEQ ID NO: 358) | SYGIS (SEQ ID NO: 365) | WISAYNGNTNYAQKLQG (SEQ ID NO: 386) | ERVSQRGAFDI (SEQ ID NO: 405) |
| RASQSISSYLN (SEQ ID NO: 346) | AASSLQS (SEQ ID NO: 353) | QQSYSTPLT (SEQ ID NO: 358) | SYSMN (SEQ ID NO: 366) | YISSSSSTIYYADSVKG (SEQ ID NO: 387) | GNPDKDPFDY (SEQ ID NO: 406) |
| RASQSISSYLN (SEQ ID NO: 346) | AASSLQS (SEQ ID NO: 353) | QQSYSTPLT (SEQ ID NO: 358) | SGSYYWS (SEQ ID NO: 367) | YIYYSGSTNYNPSLKS (SEQ ID NO: 388) | DFYCTNWYFDL (SEQ ID NO: 407) |
| RASQSISSYLN (SEQ ID NO: 346) | AASSLQS (SEQ ID NO: 353) | QQSYSTPLT (SEQ ID NO: 358) | SYYWS (SEQ ID NO: 368) | YIYYSGSTNYNPSLKS (SEQ ID NO: 388) | ESSSGSYWYFDL (SEQ ID NO: 408) |
| RASQSISSYLN (SEQ ID NO: 346) | AASSLQS (SEQ ID NO: 353) | QQSYSTPLT (SEQ ID NO: 358) | SYWIG (SEQ ID NO: 369) | IIYPGDSDTRYSPSFQG (SEQ ID NO: 389) | DSGYKYNLYYYYYYMDV (SEQ ID NO: 409) |
| ASSTGAVTSGYYPN (SEQ ID NO: 347) | STSNKHS (SEQ ID NO: 354) | LLYYGGAQWV (SEQ ID NO: 359) | SYGIS (SEQ ID NO: 365) | WISAYNGNTNYAQKLQG (SEQ ID NO: 386) | GGDLSHYYYYMDV (SEQ ID NO: 410) |
| RASQSISSYLN (SEQ ID NO: 346) | AASSLQS (SEQ ID NO: 353) | QQSYSTPLT (SEQ ID NO: 358) | SYGIS (SEQ ID NO: 365) | WISAYNGNTNYAQKLQG (SEQ ID NO: 386) | ENRRYNSCYYFDY (SEQ ID NO: 411) |
| ASSTGAVTSGYYPN (SEQ ID NO: 347) | STSNKHS (SEQ ID NO: 354) | LLYYGGAQWV (SEQ ID NO: 359) | SYGIS (SEQ ID NO: 365) | WISAYNGNTNYAQKLQG (SEQ ID NO: 386) | GGDLSHYYYYLDV (SEQ ID NO: 412) |
| RASQSISSYLN (SEQ ID NO: 346) | AASSLQS (SEQ ID NO: 353) | QQSYSTPLT (SEQ ID NO: 358) | SNYMS (SEQ ID NO: 370) | VIYSGGSTYYADSVKG (SEQ ID NO: 390) | ATLLSLSYDAFDI (SEQ ID NO: 413) |
| ASSTGAVTSGYYPN (SEQ ID NO: 347) | STSNKHS (SEQ ID NO: 354) | LLYYGGAQWV (SEQ ID NO: 359) | SYGIS (SEQ ID NO: 365) | WISAYNGNTNYAQKLQG (SEQ ID NO: 386) | GGDLSHYYYMDV (SEQ ID NO: 414) |
| RASQSISSYLN (SEQ ID NO: 346) | AASSLQS (SEQ ID NO: 353) | QQSYSTPLT (SEQ ID NO: 358) | SYWIG (SEQ ID NO: 369) | I1YPGDSDTRYSPSFQG (SEQ ID NO: 389) | ERDRWFDP (SEQ ID NO: 415) |
| TGTSSDVGGYNYVS (SEQ ID NO: 348) | EVSKRPS (SEQ ID NO: 355) | SSYAGSNNWV (SEQ ID NO: 360) | SYGIS (SEQ ID NO: 365) | WISAYNGNTNYAQKLQG (SEQ ID NO: 386) | ETPPSLGAFDI (SEQ ID NO: 416) |

TABLE 6-continued

CDRs corresponding to HLA antigen binding domains

| CDR-L1 | CDR-L2 | CDR-L3 | CDR-H1 | CDR-H2 | CDR-H3 |
|---|---|---|---|---|---|
| SGSSSNIGSNT VN (SEQ ID NO: 349) | SNNQRPS (SEQ ID NO: 356) | AAWDDSLNG WV (SEQ ID NO: 361) | SSSYYWG (SEQ ID NO: 371) | SIYYSGSTYYN PSLKS (SEQ ID NO: 391) | EAYCLSDSYW YFDL (SEQ ID NO: 417) |
| RASQSISSYLN (SEQ ID NO: 346) | AASSLQS (SEQ ID NO: 353) | QQSYSTPLT (SEQ ID NO: 358) | SGGYYWS (SEQ ID NO: 372) | YIYYSGSTYYN PSLKS (SEQ ID NO: 392) | ESWKYFYPRG YMDV (SEQ ID NO: 418) |
| HLA-B*07 CDRs | | | | | |
| RASENIYSNLA (SEQ ID NO: 350) | AATYLPD (SEQ ID NO: 357) | QHFWVTPYT (SEQ ID NO: 362) | SGYSWH (SEQ ID NO: 373) | YIHFSGSTHYH PSLKS (SEQ ID NO: 393) | GGVVSHYAM DC (SEQ ID NO: 419) |
| HLA-A*11 CDRs | | | | | |
| RASQSISSYLN (SEQ ID NO: 346) | AASSLQS (SEQ ID NO: 353) | QQSYSTPLT (SEQ ID NO: 358) | SGGYYWS (SEQ ID NO: 372) | YIYYSGSTYYN PSLKS (SEQ ID NO: 392) | HYYYYMDV (SEQ ID NO: 420) |
| RASQSISSYLN (SEQ ID NO: 346) | AASSLQS (SEQ ID NO: 353) | QQSYSTPLT (SEQ ID NO: 358) | TSGVGVG (SEQ ID NO: 374) | LIYWNDDKRY SPSLKS (SEQ ID NO: 394) | KTTSFYFDY (SEQ ID NO: 421) |
| RASQSISSYLN (SEQ ID NO: 346) | AASSLQS (SEQ ID NO: 353) | QQSYSTPLT (SEQ ID NO: 358) | SGGYYWS (SEQ ID NO: 372) | YIYYSGSTYYN PSLKS (SEQ ID NO: 392) | HYYYYMDV (SEQ ID NO: 422) |
| RASQSISSYLN (SEQ ID NO: 346) | AASSLQS (SEQ ID NO: 353) | QQSYSTPLT (SEQ ID NO: 358) | SYWMH (SEQ ID NO: 375) | RINSDGSSTSY ADSVKG (SEQ ID NO: 395) | GVLLYNWFD P (SEQ ID NO: 423) |
| RASQSISSYLN (SEQ ID NO: 346) | AASSLQS (SEQ ID NO: 353) | QQSYSTPLT (SEQ ID NO: 358) | SGGYYWS (SEQ ID NO: 372) | YIYYSGSTYYN PSLKS (SEQ ID NO: 392) | HYYYYYLDV (SEQ ID NO: 424) |
| RASQSISSYLN (SEQ ID NO: 346) | AASSLQS (SEQ ID NO: 353) | QQSYSTPLT (SEQ ID NO: 358) | SYDMH (SEQ ID NO: 376) | AIGTAGDTYY PGSVKG (SEQ ID NO: 396) | DLPGSYWYFD L (SEQ ID NO: 425) |
| RASQSISSYLN (SEQ ID NO: 346) | AASSLQS (SEQ ID NO: 353) | QQSYSTPLT (SEQ ID NO: 358) | SYAMH (SEQ ID NO: 377) | WINAGNGNT KYSQKFQG (SEQ ID NO: 397) | EGNGANPDA FDI (SEQ ID NO: 426) |
| RASQSISSYLN (SEQ ID NO: 346) | AASSLQS (SEQ ID NO: 353) | QQSYSTPLT (SEQ ID NO: 358) | TSGVGVG (SEQ ID NO: 374) | LIYWNDDKRY SPSLKS (SEQ ID NO: 394) | RHMRLSCFDY (SEQ ID NO: 427) |
| RASQSISSYLN (SEQ ID NO: 346) | AASSLQS (SEQ ID NO: 353) | QQSYSTPLT (SEQ ID NO: 358) | SGGYYWS (SEQ ID NO: 372) | YIYYSGSTYYN PSLKS (SEQ ID NO: 392) | HYYYYSMDV (SEQ ID NO: 428) |
| HLA-C*07 CDR | | | | | |
| RASQSISSYLN (SEQ ID NO: 346) | AASSLQS (SEQ ID NO: 353) | QQSYSTPLT (SEQ ID NO: 358) | SYAMS (SEQ ID NO: 378) | AISGSGGSTYY ADSVKG (SEQ ID NO: 398) | SFDWFDP (SEQ ID NO: 429) |
| RASQSISSYLN (SEQ ID NO: 346) | AASSLQS (SEQ ID NO: 353) | QQSYSTPLT (SEQ ID NO: 358) | SGGYYWS (SEQ ID NO: 372) | YIYYSGSTYYN PSLKS (SEQ ID NO: 392) | ERSISPYYYYY MDV (SEQ ID NO: 430) |
| SGSSSNIGSNT VN (SEQ ID NO: 349) | SNNQRPS (SEQ ID NO: 356) | AAWDDSLNG WV (SEQ ID NO: 361) | SSSYYWG (SEQ ID NO: 371) | SIYYSGSTYYN PSLKS (SEQ ID NO: 391) | DSVIWYWFD P (SEQ ID NO: 431) |
| RASQSISSYLN (SEQ ID NO: 346) | AASSLQS (SEQ ID NO: 353) | QQSYSTPLT (SEQ ID NO: 358) | SGGYYWS (SEQ ID NO: 372) | YIYYSGSTYYN PSLKS (SEQ ID NO: 392) | EEILPRLSYYYY MDV (SEQ ID NO: 432) |
| RASQSISSYLN (SEQ ID NO: 346) | AASSLQS (SEQ ID NO: 353) | QQSYSTPLT (SEQ ID NO: 358) | SYAMN (SEQ ID NO: 379) | WINTNTGNP TYAQGFTG (SEQ ID NO: 399) | GGRAHSSWY FDL (SEQ ID NO: 433) |

TABLE 6-continued

CDRs corresponding to HLA antigen binding domains

| CDR-L1 | CDR-L2 | CDR-L3 | CDR-H1 | CDR-H2 | CDR-H3 |
|---|---|---|---|---|---|
| RASQSISSYLN (SEQ ID NO: 346) | AASSLQS (SEQ ID NO: 353) | QQSYSTPLT (SEQ ID NO: 358) | SGGYYWS (SEQ ID NO: 372) | YIYYSGSTYYN PSLKS (SEQ ID NO: 392) | DRIKILPRLGY YYYMDV (SEQ ID NO: 434) |
| RASQSISSYLN (SEQ ID NO: 346) | AASSLQS (SEQ ID NO: 353) | QQSYSTPLT (SEQ ID NO: 358) | SGGYYWS (SEQ ID NO: 372) | YIYYSGSTYYN PSLKS (SEQ ID NO: 392) | DTVIHYYYYM DV (SEQ ID NO: 435) |
| RASQSISSYLN (SEQ ID NO: 346) | AASSLQS (SEQ ID NO: 353) | QQSYSTPLT (SEQ ID NO: 358) | SGGYYWS (SEQ ID NO: 372) | YIYYSGSTYYN PSLKS (SEQ ID NO: 392) | DVIVEVFLSYY YYMDV (SEQ ID NO: 436) |
| RASQSISSYLN (SEQ ID NO: 346) | AASSLQS (SEQ ID NO: 353) | QQSYSTPLT (SEQ ID NO: 358) | SGGYYWS (SEQ ID NO: 372) | YIYYSGSTYYN PSLKS (SEQ ID NO: 392) | DIFIHYYYYM DV (SEQ ID NO: 437) |
| RASQSISSYLN (SEQ ID NO: 346) | AASSLQS (SEQ ID NO: 353) | QQSYSTPLT (SEQ ID NO: 358) | SYSMN (SEQ ID NO: 366) | YISSSSSTIYYA DSVKG (SEQ ID NO: 387) | DGTFYSYSPYY FDY (SEQ ID NO: 438) |
| RASQSISSYLN (SEQ ID NO: 346) | AASSLQS (SEQ ID NO: 353) | QQSYSTPLT (SEQ ID NO: 358) | SGGYYWS (SEQ ID NO: 372) | YIYYSGSTYYN PSLKS (SEQ ID NO: 392) | EWIKILPRLGY YYYMDV (SEQ ID NO: 439) |
| RASQSISSYLN (SEQ ID NO: 346) | AASSLQS (SEQ ID NO: 353) | QQSYSTPLT (SEQ ID NO: 358) | SGGYYWS (SEQ ID NO: 372) | YIYYSGSTYYN PSLKS (SEQ ID NO: 392) | DRSLYYYYYM DV (SEQ ID NO: 440) |
| RASQSISSYLN (SEQ ID NO: 346) | AASSLQS (SEQ ID NO: 353) | QQSYSTPLT (SEQ ID NO: 358) | SGGYYWS (SEQ ID NO: 372) | YIYYSGSTYYN PSLKS (SEQ ID NO: 392) | DKILAPNYYYY MDV (SEQ ID NO: 441) |
| RASQSISSYLN (SEQ ID NO: 346) | AASSLQS (SEQ ID NO: 353) | QQSYSTPLT (SEQ ID NO: 358) | SGGYYWS (SEQ ID NO: 372) | YIYYSGSTYYN PSLKS (SEQ ID NO: 392) | EKSWKYFYYY YYYMDV (SEQ ID NO: 442) |
| RASQSISSYLN (SEQ ID NO: 346) | AASSLQS (SEQ ID NO: 353) | QQSYSTPLT (SEQ ID NO: 358) | SGGYYWS (SEQ ID NO: 372) | YIYYSGSTYYN PSLKS (SEQ ID NO: 392) | ENTSTIPYYYY YMDV (SEQ ID NO: 443) |
| RASQSISSYLN (SEQ ID NO: 346) | AASSLQS (SEQ ID NO: 353) | QQSYSTPLT (SEQ ID NO: 358) | SGGYYWS (SEQ ID NO: 372) | YIYYSGSTYYN PSLKS (SEQ ID NO: 392) | EDVDKNTSTI YYYYYMDV (SEQ ID NO: 444) |
| RASQGISSAL A (SEQ ID NO: 351) | DASSLES (SEQ ID NO: 55) | QQFNSYPLT (SEQ ID NO: 60) | DYYMS (SEQ ID NO: 380) | YISSSGSTIYYA DSVKG (SEQ ID NO: 400) | DGGDIVSSSAI YWYFDL (SEQ ID NO: 445) |
| RASQSISSYLN (SEQ ID NO: 346) | AASSLQS (SEQ ID NO: 353) | QQSYSTPLT (SEQ ID NO: 358) | SGGYYWS (SEQ ID NO: 372) | YIYYSGSTYYN PSLKS (SEQ ID NO: 392) | DLILPPYYYYY MDV (SEQ ID NO: 446) |
| RASQSISSYLN (SEQ ID NO: 346) | AASSLQS (SEQ ID NO: 353) | QQSYSTPLT (SEQ ID NO: 358) | SGGYYWS (SEQ ID NO: 372) | YIYYSGSTYYN PSLKS (SEQ ID NO: 392) | ETWIKILPRYY YYYYMDV (SEQ ID NO: 447) |
| RASQSISSYLN (SEQ ID NO: 346) | AASSLQS (SEQ ID NO: 353) | QQSYSTPLT (SEQ ID NO: 358) | SGGYYWS (SEQ ID NO: 372) | YIYYSGSTYYN PSLKS (SEQ ID NO: 392) | DLSRYYYYYM DV (SEQ ID NO: 448) |
| RASQGISSWL A (SEQ ID NO: 352) | AASSLQS (SEQ ID NO: 353) | QQYNSYPLT (SEQ ID NO: 363) | SYSMN (SEQ ID NO: 366) | YISSSSSTIYYA DSVKG (SEQ ID NO: 387) | EHIVLCFDY (SEQ ID NO: 449) |
| RASQSISSYLN (SEQ ID NO: 346) | AASSLQS (SEQ ID NO: 353) | QQSYSTPLT (SEQ ID NO: 358) | SGGYYWS (SEQ ID NO: 372) | YIYYSGSTYYN PSLKS (SEQ ID NO: 392) | DKILPRPYYYY YMDV (SEQ ID NO: 450) |

TABLE 6-continued

CDRs corresponding to HLA antigen binding domains

| CDR-L1 | CDR-L2 | CDR-L3 | CDR-H1 | CDR-H2 | CDR-H3 |
|---|---|---|---|---|---|
| TGTSSDVGGY NYVS (SEQ ID NO: 348) | EVSKRPS (SEQ ID NO: 355) | SSYAGSNNW V (SEQ ID NO: 360) | SYGIS (SEQ ID NO: 365) | WISAYNGNT NYAQKLQG (SEQ ID NO: 386) | GSNEYFQH (SEQ ID NO: 451) |
| RASQSISSYLN (SEQ ID NO: 346) | AASSLQS (SEQ ID NO: 353) | QQSYSTPLT (SEQ ID NO: 358) | SYAMN (SEQ ID NO: 379) | WINTNTGNP TYAQGFTG (SEQ ID NO: 399) | GTSYWYFDL (SEQ ID NO: 452) |
| RASQSISSYLN (SEQ ID NO: 346) | AASSLQS (SEQ ID NO: 353) | QQSYSTPLT (SEQ ID NO: 358) | SGGYYWS (SEQ ID NO: 372) | YIYYSGSTYYN PSLKS (SEQ ID NO: 392) | EEIVEVFYYYY MDV (SEQ ID NO: 453) |
| RASQSISSYLN (SEQ ID NO: 346) | AASSLQS (SEQ ID NO: 353) | QQSYSTPLT (SEQ ID NO: 358) | SYAMS (SEQ ID NO: 378) | AISGSGGSTYY ADSVKG (SEQ ID NO: 398) | VDDYYFDY (SEQ ID NO: 454) |
| RASQSISSYLN (SEQ ID NO: 346) | AASSLQS (SEQ ID NO: 353) | QQSYSTPLT (SEQ ID NO: 358) | SYWMH (SEQ ID NO: 375) | RINSDGSSTSY ADSVKG (SEQ ID NO: 395) | STNILLSYTKA FDI (SEQ ID NO: 455) |
| RASQSISSYLN (SEQ ID NO: 346) | AASSLQS (SEQ ID NO: 353) | QQSYSTPLT (SEQ ID NO: 358) | SGGYYWS (SEQ ID NO: 372) | YIYYSGSTYYN PSLKS (SEQ ID NO: 392) | DKTYYYYYM DV (SEQ ID NO: 456) |
| RASQSISSYLN (SEQ ID NO: 346) | AASSLQS (SEQ ID NO: 353) | QQSYSTPLT (SEQ ID NO: 358) | SGGYYWS (SEQ ID NO: 372) | YIYYSGSTYYN PSLKS (SEQ ID NO: 392) | EKYFHDKYFH DYYYYYMDV (SEQ ID NO: 457) |
| RASQSISSYLN (SEQ ID NO: 346) | AASSLQS (SEQ ID NO: 353) | QQSYSTPLT (SEQ ID NO: 358) | SGGYYWS (SEQ ID NO: 372) | YIYYSGSTYYN PSLKS (SEQ ID NO: 392) | DTSVYYYYYM DV (SEQ ID NO: 458) |
| RASQSISSYLN (SEQ ID NO: 346) | AASSLQS (SEQ ID NO: 353) | QQSYSTPLT (SEQ ID NO: 358) | SGGYYWS (SEQ ID NO: 372) | YIYYSGSTYYN PSLKS (SEQ ID NO: 392) | EKILPYYYYYY MDV (SEQ ID NO: 459) |
| SGSSSNIGSNT VN (SEQ ID NO: 349) | SNNQRPS (SEQ ID NO: 356) | AAWDDSLNG WV (SEQ ID NO: 361) | SYSMN (SEQ ID NO: 366) | YISSSSSTIYYA DSVKG (SEQ ID NO: 387) | QWIYIYINPR GFIFLHDAFDI (SEQ ID NO: 460) |
| RASQSISSYLN (SEQ ID NO: 346) | AASSLQS (SEQ ID NO: 353) | QQSYSTPLT (SEQ ID NO: 358) | SNSAAWN (SEQ ID NO: 381) | RTYYRSKWYN DYAVSVKS (SEQ ID NO: 401) | EDVDFHHDA FDI (SEQ ID NO: 461) |
| RASQSISSYLN (SEQ ID NO: 346) | AASSLQS (SEQ ID NO: 353) | QQSYSTPLT (SEQ ID NO: 358) | SGGYYWS (SEQ ID NO: 372) | YIYYSGSTYYN PSLKS (SEQ ID NO: 392) | EGVDKNTSTI YYYYYMDV (SEQ ID NO: 462) |
| RASQGISSWL A (SEQ ID NO: 352) | AASSLQS (SEQ ID NO: 353) | QQYNSYPLT (SEQ ID NO: 363) | SYSMN (SEQ ID NO: 366) | YISSSSSTIYYA DSVKG (SEQ ID NO: 387) | DRRGYFDL (SEQ ID NO: 463) |
| RASQSISSYLN (SEQ ID NO: 346) | AASSLQS (SEQ ID NO: 353) | QQSYSTPLT (SEQ ID NO: 358) | DYYMH (SEQ ID NO: 382) | LVDPEDGETIY AEKFQG (SEQ ID NO: 402) | GIHVDIRSME DWFDP (SEQ ID NO: 464) |
| RASQSISSYLN (SEQ ID NO: 346) | AASSLQS (SEQ ID NO: 353) | QQSYSTPLT (SEQ ID NO: 358) | SGGYYWS (SEQ ID NO: 372) | YIYYSGSTYYN PSLKS (SEQ ID NO: 392) | DIGTSYYYYM DV (SEQ ID NO: 465) |
| RASQSISSYLN (SEQ ID NO: 346) | AASSLQS (SEQ ID NO: 353) | QQSYSTPLT (SEQ ID NO: 358) | SGGYYWS (SEQ ID NO: 372) | YIYYSGSTYYN PSLKS (SEQ ID NO: 392) | EVVEVFLYYYY YMDV (SEQ ID NO: 466) |
| RASQSISSYLN (SEQ ID NO: 346) | AASSLQS (SEQ ID NO: 353) | QQSYSTPLT (SEQ ID NO: 358) | SGGYYWS (SEQ ID NO: 372) | YIYYSGSTYYN PSLKS (SEQ ID NO: 392) | DLYYYYYYYM DV (SEQ ID NO: 467) |

TABLE 6-continued

CDRs corresponding to HLA antigen binding domains

| CDR-L1 | CDR-L2 | CDR-L3 | CDR-H1 | CDR-H2 | CDR-H3 |
|---|---|---|---|---|---|
| RASQSISSYLN (SEQ ID NO: 346) | AASSLQS (SEQ ID NO: 353) | QQSYSTPLT (SEQ ID NO: 358) | SGGYYWS (SEQ ID NO: 372) | YIYYSGSTYYN PSLKS (SEQ ID NO: 392) | ESWKYFYPRG SIFIHYYYYMD V (SEQ ID NO: 468) |
| RASQSISSYLN (SEQ ID NO: 346) | AASSLQS (SEQ ID NO: 353) | QQSYSTPLT (SEQ ID NO: 358) | SGGYYWS (SEQ ID NO: 372) | YIYYSGSTYYN PSLKS (SEQ ID NO: 392) | DRIVEVFYYYY MDV (SEQ ID NO: 469) |
| RASQSISSYLN (SEQ ID NO: 346) | AASSLQS (SEQ ID NO: 353) | QQSYSTPLT (SEQ ID NO: 358) | SGGYYWS (SEQ ID NO: 372) | YIYYSGSTYYN PSLKS (SEQ ID NO: 392) | EKYFHDWLYY YYYMDV (SEQ ID NO: 470) |
| RASQSISSYLN (SEQ ID NO: 346) | AASSLQS (SEQ ID NO: 353) | QQSYSTPLT (SEQ ID NO: 358) | SGGYYWS (SEQ ID NO: 372) | YIYYSGSTYYN PSLKS (SEQ ID NO: 392) | DLVDKNTSYY YYYMDV (SEQ ID NO: 471) |
| TGTSSDVGGY NYVS (SEQ ID NO: 348) | EVSKRPS (SEQ ID NO: 355) | SSYAGSNNW V (SEQ ID NO: 360) | SYGIS (SEQ ID NO: 365) | WISAYNGNT NYAQKLQG (SEQ ID NO: 386) | VQNEYFQH (SEQ ID NO: 472) |
| RASQGISSWL A (SEQ ID NO: 352) | AASSLQS (SEQ ID NO: 353) | QQANSFPLT (SEQ ID NO: 364) | DYYMS (SEQ ID NO: 380) | YISSSGSTIYYA DSVKG (SEQ ID NO: 400) | ANWFDP (SEQ ID NO: 473) |
| HLA-A*01 CDRs | | | | | |
| ASSTGAVTSG YYPN (SEQ ID NO: 347) | STSNKHS (SEQ ID NO: 354) | LLYYGGAQW V (SEQ ID NO: 359) | SYGIS (SEQ ID NO: 365) | WISAYNGNT NYAQKLQG (SEQ ID NO: 386) | GGWTAWYYY MDV (SEQ ID NO: 474) |
| SGSSSNIGSNT VN (SEQ ID NO: 349) | SNNQRPS (SEQ ID NO: 356) | AAWDDSLNG WV (SEQ ID NO: 361) | SYSMN (SEQ ID NO: 366) | YISSSSSTIYYA DSVKG (SEQ ID NO: 387) | AKYYYMDV (SEQ ID NO: 475) |
| RASQSISSYLN (SEQ ID NO: 346) | AASSLQS (SEQ ID NO: 353) | QQSYSTPLT (SEQ ID NO: 358) | SGGYYWS (SEQ ID NO: 372) | YIYYSGSTYYN PSLKS (SEQ ID NO: 392) | DQVDKNTYYY MDV (SEQ ID NO: 476) |
| RASQGISSWL A (SEQ ID NO: 352) | AASSLQS (SEQ ID NO: 353) | QQANSFPLT (SEQ ID NO: 364) | DYYMS (SEQ ID NO: 380) | YISSSGSTIYYA DSVKG (SEQ ID NO: 400) | ACQLAEYFQH (SEQ ID NO: 477) |
| RASQSISSYLN (SEQ ID NO: 346) | AASSLQS (SEQ ID NO: 353) | QQSYSTPLT (SEQ ID NO: 358) | SGGYYWS (SEQ ID NO: 372) | YIYYSGSTYYN PSLKS (SEQ ID NO: 392) | DRVDKNTSYY YMDV (SEQ ID NO: 478) |
| RASQSISSYLN (SEQ ID NO: 346) | AASSLQS (SEQ ID NO: 353) | QQSYSTPLT (SEQ ID NO: 358) | SSNWWG (SEQ ID NO: 383) | YIYYSGSTYYN PSLKS (SEQ ID NO: 392) | RVQLKLVHW FDP (SEQ ID NO: 479) |
| RASQSISSYLN (SEQ ID NO: 346) | AASSLQS (SEQ ID NO: 353) | QQSYSTPLT (SEQ ID NO: 358) | SYDIN (SEQ ID NO: 384) | WMNPNSGN TGYAQKFQG (SEQ ID NO: 403) | YYDYVTVFYF QH (SEQ ID NO: 480) |
| RASQSISSYLN (SEQ ID NO: 346) | AASSLQS (SEQ ID NO: 353) | QQSYSTPLT (SEQ ID NO: 358) | SGGYSWS (SEQ ID NO: 385) | YIYHSGSTYYN PSLKS (SEQ ID NO: 404) | ESYPSFYAFDI (SEQ ID NO: 481) |
| RASQSISSYLN (SEQ ID NO: 346) | AASSLQS (SEQ ID NO: 353) | QQSYSTPLT (SEQ ID NO: 358) | TSGVGVG (SEQ ID NO: 374) | LIYWNDDKRY SPSLKS (SEQ ID NO: 394) | SNMWSYSLN DYYFDY (SEQ ID NO: 482) |

In some embodiments, the non-target antigen comprises HLA-A. In some embodiments, the ligand binding domain of the second, inhibitory receptor comprises an HLA-A*01, HLA-A*02, HLA-A*03 or HLA-A*11 ligand binding domain comprising CDR sequences as set forth in Table 6.

In some embodiments, the non-target antigen comprises HLA-B. In some embodiments, the ligand binding domain of the second, inhibitory receptors comprises an HLA-B*07 ligand binding domain comprising CDR sequences as set forth in Table 6.

In some embodiments, the non-target antigen comprises HLA-C. In some embodiments, the ligand binding domain of the second, inhibitory receptors comprises an HLA-C*07 ligand binding domain comprising CDR sequences as set forth in Table 6.

In some embodiments, the extracellular ligand binding domain of the second receptor specifically binds an allelic variant of an HLA-A, HLA-B, or HLA-C protein. In some embodiments, the extracellular ligand binding domain of the second receptor specifically binds to HLA-A*01, HLA-A*02, HLA-A*03, HLA-A*11, HLA-1B*07, or HLA-C*07.

In some embodiments, the extracellular ligand binding domain of the second receptor specifically binds to HLA-A*01. In some embodiments, the extracellular ligand binding domain of the second receptor comprises HLA-A*01 complementarity determining regions (CDRs) CDR-L1, CDR-L2, CDR-L3, CDR-H1, CDR-H2, CDR-H3 as disclosed Table 6; or CDR sequences having at most 1, 2, or 3 substitutions, deletions, or insertions relative to the HLA-A*01 CDRs of Table 6.

In some embodiments, the extracellular ligand binding domain of the second receptor specifically binds to HLA-A*02. In some embodiments, the extracellular ligand binding domain of the second receptor comprises HLA-A*02 complementarity determining regions (CDRs) CDR-L1, CDR-L2, CDR-L3, CDR-H1, CDR-H2, CDR-H3 as disclosed Table 6; or CDR sequences having at most 1, 2, or 3 substitutions, deletions, or insertions relative to the HLA-A*02 CDRs of Table 6.

In some embodiments, the extracellular ligand binding domain of the second receptor comprises complementarity determining regions (CDRs) CDR-L1, CDR-L2, CDR-L3, CDR-H1, CDR-H2, CDR-H3 of SEQ ID NOS: 103-108 or of SEQ ID NOS: 109-114; or CDR sequences having at most 1, 2, or 3 substitutions, deletions, or insertions relative to the CDRs of SEQ ID NOS: 103-108 or SEQ ID NOS: 109-114.

In some embodiments, the extracellular ligand binding domain of the second receptor specifically binds to HLA-A*03. In some embodiments, the extracellular ligand binding domain of the second receptor comprises HLA-A*03 complementarity determining regions (CDRs) CDR-L1, CDR-L2, CDR-L3, CDR-H1, CDR-H2, CDR-H3 as disclosed Table 6; or CDR sequences having at most 1, 2, or 3 substitutions, deletions, or insertions relative to the HLA-A*03 CDRs of Table 6.

In some embodiments, the extracellular ligand binding domain of the second receptor specifically binds to HLA-A*11. In some embodiments, the extracellular ligand binding domain of the second receptor comprises HLA-A*11 complementarity determining regions (CDRs) CDR-L1, CDR-L2, CDR-L3, CDR-H1, CDR-H2, CDR-H3 as disclosed Table 6; or CDR sequences having at most 1, 2, or 3 substitutions, deletions, or insertions relative to the HLA-A*11 CDRs of Table 6.

In some embodiments, the extracellular ligand binding domain of the second receptor specifically binds to HLA-1B*07. In some embodiments, the extracellular ligand binding domain of the second receptor comprises HLA-B*07 complementarity determining regions (CDRs) CDR-L1, CDR-L2, CDR-L3, CDR-H1, CDR-H2, CDR-H3 as disclosed Table 6; or CDR sequences having at most 1, 2, or 3 substitutions, deletions, or insertions relative to the HLA-B*07 CDRs of Table 6.

In some embodiments, the extracellular ligand binding domain of the second receptor specifically binds to HLA-C*07. In some embodiments, the extracellular ligand binding domain of the second receptor comprises HLA-C*07 complementarity determining regions (CDRs) CDR-L1, CDR-L2, CDR-L3, CDR-H1, CDR-H2, CDR-H3 as disclosed Table 6; or CDR sequences having at most 1, 2, or 3 substitutions, deletions, or insertions relative to the HLA-C*07 CDRs of Table 6.

In further embodiments of any of the ligand binding domains, each CDR sequence may have 1, 2, 3 or more substitutions, insertions, or deletions. CDR sequences may tolerate substitutions, deletions, or insertions. Using sequence alignment tools, routine experimentation, and known assays, those of skill in the art may generate and test variant sequences having 1, 2, 3, or more substitutions, insertions, or deletions in CDR sequences without undue experimentation.

In some embodiments, the non-target antigen comprises HLA-A*02, and the ligand binding domain of the second receptor comprises an HLA-A*02 ligand binding domain. In some embodiments, the ligand binding domain binds HLA-A*02 independent of the peptide in a pMHC complex comprising HLA-A*02. In some embodiments, the HLA-A*02 ligand binding domain comprises an scFv domain. In some embodiments, the HLA-A*02 ligand binding domain comprises a sequence of any one of SEQ ID NOs: 91-102. In some embodiments, the HLA-A*02 ligand binding domain comprises a sequence at least 90%, at least 95% or at least 99% identical to a sequence of any one of SEQ ID NOs: 91-102.

In some embodiments, the HLA-A*02 scFv comprises the complementarity determined regions (CDRs) of any one of SEQ ID NOS: 103-114. In some embodiments, the scFv comprises a sequence at least 95% identical to any one of SEQ ID NOS: 103-114. In some embodiments, the scFv comprises a sequence identical to any one of SEQ ID NOS: 103-114. In some embodiments, the heavy chain of the antigen binding domain comprises the heavy chain CDRs of any one of SEQ ID NOS: 103-114, and wherein the light chain of the antigen binding domain comprises the light chain CDRs of any one of SEQ ID NOS: 103-114. In some embodiments, the HLA-A*02 antigen binding domain comprises a heavy chain and a light chain, and the heavy chain comprises CDRs selected from SEQ ID NOs: 106-108 and 112-14 and the light chain comprises CDRs selected from SEQ ID NOs: 103-15 and 109-111.

In some embodiments, the HLA-A*02 antigen binding domain comprises a heavy chain and a light chain, and the heavy chain comprises a sequence at least 95% identical to the heavy chain portion of any one of SEQ ID NOS: 91-102, and the light chain comprises a sequence at least 95% identical to the light chain portion of any one of SEQ ID NOS: 91-102.

In some embodiments, the heavy chain comprises a sequence identical to the heavy chain portion of any one of SEQ ID NOS: 91-102, and wherein the light chain of comprises a sequence identical to the light chain portion of any one of SEQ ID NOS: 91-102.

In some embodiments, the HLA-A*02 scFv comprises a sequence at least 95% identical, at least 96% identical, at least 97% identical, at least 98% identical, at least 99% identical or identical to any one of SEQ ID NOs: 91-102. In some embodiments, the HLA-A*02 scFv comprises a sequence identical to any one of SEQ ID NOs: 91-102.

In some embodiments, the non-target antigen comprises HLA-A*01, and the extracellular ligand binding domain of the second receptor comprises an HLA-A*01 ligand binding domain. In some embodiments, the HLA-A*1 ligand binding domain comprises an scFv domain comprising a sequence selected from the group of sequences set forth in Table 5, or a sequence at least 90%, at least 95% or at least 99% identical to thereto. In some embodiments, the HLA-A*01 scFv comprises HLA-A*1 CDR sequences as set forth in Table 6.

In some embodiments, the non-target antigen comprises HLA-A*03, and the extracellular ligand binding domain of the second receptor comprises an HLA-A*03 ligand binding domain. In some embodiments, the HLA-A*03 ligand binding domain comprises an scFv domain comprising a sequence selected from the group of sequences set forth in Table 5, or a sequence at least 90%, at least 95% or at least 99% identical to thereto. In some embodiments, the HLA-A*03 scFv comprises HLA-A*03 CDR sequences as set forth in Table 6.

In some embodiments, the non-target antigen comprises HLA-A*111, and the extracellular ligand binding domain of the second receptor comprises an HLA-A*11 ligand binding domain. In some embodiments, the HLA-A*11 ligand binding domain comprises an scFv domain comprising a sequence selected from the group of sequences set forth in Table 5, or a sequence at least 90%, at least 95% or at least 99% identical to thereto. In some embodiments, the HLA-A*11 scFv comprises HLA-A*11 CDR sequences as set forth in Table 6.

In some embodiments, the non-target antigen comprises HLA-B*07, and the extracellular ligand binding domain of the second receptor comprises an HLA-B*07 ligand binding domain. In some embodiments, the HLA-B*07 ligand binding domain comprises an scFv domain comprising a sequence selected from the group of sequences set forth in Table 5, or a sequence at least 90%, at least 95% or at least 99% identical to thereto. In some embodiments, the HLA-B*07 scFv comprises HLA-B*07 CDR sequences as set forth in Table 6.

In some embodiments, the non-target antigen comprises HLA-C*07, and the extracellular ligand binding domain of the second receptor comprises an HLA-C*07 ligand binding domain. In some embodiments, the HLA-C*07 ligand binding domain comprises an scFv domain comprising a sequence selected from the group of sequences set forth in Table 5, or a sequence at least 90%, at least 95% or at least 99% identical to thereto. In some embodiments, the HLA-C*07 scFv comprises HLA-C*07 CDR sequences as set forth in Table 6.

Inhibitory Receptors

The disclosure provides a second receptor that is an inhibitory chimeric antigen receptor. The inhibitory receptor may comprise an extracellular ligand binding domain that binds to and recognizes the non-target antigen or a peptide derivative thereof in a MHC-I complex.

Exemplary inhibitory receptors are described in PCT/US2020/045228 filed on Sep. 6, 2020, PCT/US2020/064607, filed on Dec. 11, 2020, PCT/US2021/029907, filed on Apr. 29, 2021 and PCT/US2020/059856 filed on Nov. 10, 2020, the contents of each of which are incorporated herein by reference.

The term "inhibitory receptor," as used herein refers to a ligand binding domain that is fused to an intracellular signaling domain capable of transducing an inhibitory signal that inhibits or suppresses the immune activity of an immune cell. Inhibitory receptors have immune cell inhibitory potential, and are distinct and distinguishable from CARs, which are receptors with immune cell activating potential. For example, CARs are activating receptors as they include intracellular stimulatory and/or co-stimulatory domains. Inhibitory receptors are inhibiting receptors that contain intracellular inhibitory domains.

As used herein "inhibitory signal" refers to signal transduction or changes in protein expression in an immune cell resulting in suppression of an immune response (e.g., decrease in cytokine production or reduction of immune cell activation). Inhibition or suppression of an immune cell can selective and/or reversible, or not selective and/or reversible. Inhibitory receptors are responsive to non-target antigens (e.g. HLA-A*02). For example, when a non-target antigen (e.g. HLA-A*02) binds to or contacts the inhibitory receptor, the inhibitory receptor is responsive and activates an inhibitory signal in the immune cell expressing the inhibitory receptor upon binding of the non-target antigen by the extracellular ligand binding domain of the inhibitory receptor.

Inhibitory receptors of the disclosure may comprise an extracellular ligand binding domain. Any type of ligand binding domain that can regulate the activity of a receptor in a ligand dependent manner is envisaged as within the scope of the instant disclosure.

In some embodiments, the ligand binding domain is an antigen binding domain. Exemplary antigen binding domains include, inter alia, scFv, SdAb, VO-only domains, and TCR antigen binding domains derived from the TCR α and β chain variable domains.

Any type of antigen binding domain is envisaged as within the scope of the instant disclosure.

In some embodiments, the extracellular ligand binding domain of the second receptor is an scFv.

In some embodiments, the extracellular ligand binding domain of the second receptor is fused to the extracellular domain of an inhibitory CAR.

In some embodiments, the inhibitory receptors of the present disclosure comprise an extracellular hinge region. Exemplary hinges can be isolated or derived from IgD and CD8 domains, for example IgG1. In some embodiments, the hinge is isolated or derived from CD8α or CD28.

The inhibitory receptors of the present disclosure can be designed to comprise a transmembrane domain that is fused to the extracellular domain of the inhibitory receptor. In some instances, the transmembrane domain can be selected or modified by amino acid substitution to avoid binding of such domains to the transmembrane domains of the same or different surface membrane proteins to minimize interactions with other members of the receptor complex.

The transmembrane domain may be derived either from a natural or from a synthetic source. Where the source is natural, the domain may be derived from any membrane-bound or transmembrane protein. Transmembrane regions may be isolated or derived from (i.e. comprise at least the transmembrane region(s) of) the alpha, beta or zeta chain of the T-cell receptor, CD28, CD3 epsilon, CD45, CD4, CD5, CD8, CD9, CD16, CD22, CD33, CD37, CD64, CD80, CD86, CD134, CD137, CD154, or from an immunoglobulin such as IgG4. Alternatively the transmembrane domain may be synthetic, in which case it will comprise predominantly hydrophobic residues such as leucine and valine. In some embodiments, a triplet of phenylalanine, tryptophan and valine will be found at each end of a synthetic transmembrane domain. Optionally, a short oligo- or polypeptide linker, preferably between 2 and 10 amino acids in length may form the linkage between the transmembrane domain and the intracellular domain of the inhibitory receptor. A glycine-serine doublet provides a particularly suitable linker.

The disclosure provides an inhibitory receptor comprising an intracellular domain. The intracellular domain of the inhibitory receptors of the instant disclosure is responsible for inhibiting activation of the immune cells comprising the inhibitory receptor, which would otherwise be activated in response to activation signals by the first receptor. In some embodiments, the inhibitory intracellular domain comprises an immunoreceptor tyrosine-based inhibitory motif (ITIM). In some embodiments, the inhibitory intracellular domain comprising an ITIM can be isolated or derived from an immune checkpoint inhibitor such as CTLA-4 and PD-1. CTLA-4 and PD-1 are immune inhibitory receptors expressed on the surface of T cells, and play a pivotal role in attenuating or terminating T cell responses.

In some embodiments, an inhibitory intracellular domain is isolated from human tumor necrosis factor related apoptosis inducing ligand (TRAIL) receptor and CD200 receptor 1. In some embodiments, the TRAIL receptor comprises TR10A, TR10B or TR10D.

In some embodiments, an inhibitory intracellular domain is isolated from phosphoprotein membrane anchor with glycosphingolipid microdomains 1 (PAG1). In some embodiments, an inhibitory intracellular domain is isolated from leukocyte immunoglobulin like receptor B1 (LILRB1).

In some embodiments, the inhibitory domain is isolated or derived from a human protein, for example a human TRAIL receptor, CTLA-4, PD-1, PAG1 or LILRB1 protein.

In some embodiments, the inhibitory domain comprises an intracellular domain, a transmembrane or a combination thereof. In some embodiments, the inhibitory domain comprises an intracellular domain, a transmembrane domain, a hinge region or a combination thereof.

In some embodiments, the inhibitory domain is isolated or derived from killer cell immunoglobulin like receptor, three Ig domains and long cytoplasmic tail 2 (KIR3DL2), killer cell immunoglobulin like receptor, three Ig domains and long cytoplasmic tail 3 (KIR3DL3), leukocyte immunoglobulin like receptor B1 (LIR1, also called LIR-1 and LILRB1), programmed cell death 1 (PD-1), Fc gamma receptor IIB (FcgRIIB), killer cell lectin like receptor K1 (NKG2D), CTLA-4, a domain containing a synthetic consensus ITIM, a ZAP70 SH2 domain (e.g., one or both of the N and C terminal SH2 domains), or ZAP70 KI_K369A (kinase inactive ZAP70).

In some embodiments, the inhibitory domain is isolated or derived from a human protein.

In some embodiments, the second, inhibitory receptor comprises an inhibitory domain. In some embodiments, the second, inhibitory receptor comprises an inhibitory intracellular domain and/or an inhibitory transmembrane domain. In some embodiments, the inhibitory intracellular domain is fused to an intracellular domain of an inhibitory receptor. In some embodiments, the inhibitory intracellular domain is fused to the transmembrane domain of an inhibitory receptor.

In some embodiments, the second, inhibitory receptor comprises a cytoplasmic domain, a transmembrane domain, and an extracellular domain or a portion thereof isolated or derived isolated or derived from the same protein, for example an ITIM containing protein. In some embodiments, the second, inhibitory receptor comprises a hinge region isolated or derived from isolated or derived from the same protein as the intracellular domain and/or transmembrane domain, for example an ITIM containing protein.

In some embodiments, the second receptor is a TCR comprising an inhibitory domain (an inhibitory TCR). In some embodiments, the inhibitory TCR comprises an inhibitory intracellular domain and/or an inhibitory transmembrane domain. In some embodiments, the inhibitory intracellular domain is fused to the intracellular domain of TCR alpha, TCR beta, CD3 delta, CD3 gamma or CD3 epsilon or a portion thereof a TCR. In some embodiments, the inhibitory intracellular domain is fused to the transmembrane domain of TCR alpha, TCR beta, CD3 delta, CD3 gamma or CD3 epsilon.

In some embodiments, the second receptor is a TCR comprising an inhibitory domain (an inhibitory TCR). In some embodiments, the inhibitory domain is isolated or derived from LILRB1.

LILRB1 Inhibitory Receptors

The disclosure provides a second, inhibitory receptor comprising a LILRB1 inhibitory domain, and optionally, a LILRB1 transmembrane and/or hinge domain, or functional variants thereof. The inclusion of the LILRB1 transmembrane domain and/or the LILRB1 hinge domain in the inhibitory receptor may increase the inhibitory signal generated by the inhibitory receptor compared to a reference inhibitory receptor having another transmembrane domain or another hinge domains. The second, inhibitory receptor comprising the LILRB1 inhibitory domain may be a CAR or TCR, as described herein. Any suitable ligand binding domain, as described herein, may be fused to the LILRB1-based second, inhibitory receptors.

Leukocyte immunoglobulin-like receptor subfamily B member 1 (LILRB1), also known as Leukocyte immunoglobulin-like receptor B1, as well as ILT2, LIR1, MIR7, PIRB, CD85J, ILT-2 LIR-1, MIR-7 and PIR-B, is a member of the leukocyte immunoglobulin-like receptor (LIR) family. The LILRB1 protein belongs to the subfamily B class of LIR receptors. These receptors contain two to four extracellular immunoglobulin domains, a transmembrane domain, and two to four cytoplasmic immunoreceptor tyrosine-based inhibitory motifs (ITIMs). The LILRB1 receptor is expressed on immune cells, where it binds to MHC class I molecules on antigen-presenting cells and transduces a negative signal that inhibits stimulation of an immune response. LILRB1 is thought to regulate inflammatory responses, as well as cytotoxicity, and to play a role in limiting auto-reactivity. Multiple transcript variants encoding different isoforms of LILRB1 exist, all of which are contemplated as within the scope of the instant disclosure.

In some embodiments of the inhibitory receptors described herein, the inhibitory receptor comprises one or more domains isolated or derived from LILRB1. In some embodiments of the receptors having one or more domains isolated or derived from LILRB1, the one or more domains of LILRB1 comprise an amino acid sequence that is at least 80%, at least 90%, at least 95%, at least 96%, at least 97%, at least 98%, at least 99% or is identical to a sequence or subsequence of SEQ ID NO: 115. In some embodiments, the one or more domains of LILRB1 comprise an amino acid sequence that is identical to a sequence or subsequence of SEQ ID NO: 115. In some embodiments, the one or more domains of LILRB1 consist of an amino acid sequence that is at least 80%, at least 90%, at least 95%, at least 96%, at least 97%, at least 98%, at least 99% or is identical to a sequence or subsequence of SEQ ID NO: 115. In some embodiments, the one or more domains of LILRB1 consist of an amino acid sequence that is identical to a sequence or subsequence of SEQ ID NO: 115.

In some embodiments of the receptors having one or more domains isolated or derived from LILRB1, the one or more domains of LILRB1 are encoded by a polynucleotide sequence that is at least 80%, at least 90%, at least 95%, at least 96%, at least 97%, at least 98%, at least 99% or is identical to a sequence or subsequence of SEQ ID NO: 116.

In some embodiments of the receptors having one or more domains of LILRB1, the one or more domains of LILRB1 are encoded by a polynucleotide sequence that is identical to a sequence or subsequence of SEQ ID NO: 116.

In various embodiments, an inhibitory receptor is provided, comprising a polypeptide, wherein the polypeptide comprises one or more of: an LILRB1 hinge domain or functional variant thereof; an LILRB1 transmembrane domain or a functional variant thereof; and an LILRB1 intracellular domain or an intracellular domain comprising at least one, or at least two immunoreceptor tyrosine-based inhibitory motifs (ITIMs), wherein each ITIM is independently selected from NLYAAV (SEQ ID NO: 117), VTYAEV (SEQ ID NO: 118), VTYAQL (SEQ ID NO: 119), and SIYATL (SEQ ID NO: 120).

As used herein an "immunoreceptor tyrosine-based inhibitory motif" or "ITIM" refers to a conserved sequence of amino acids with a consensus sequence of S/I/V/LxYxxI/V/L (SEQ ID NO: 984), or the like, that is found in the cytoplasmic tails of many inhibitory receptors of the immune system. After ITIM-possessing inhibitory receptors interact with their ligand, the ITIM motif is phosphorylated, allowing the inhibitory receptor to recruit other enzymes, such as the phosphotyrosine phosphatases SHP-1 and SHP-2, or the inositol-phosphatase called SHIP.

In some embodiments, the polypeptide comprises an intracellular domain comprising at least one immunoreceptor tyrosine-based inhibitory motif (ITIM), at least two ITIMs, at least 3 ITIMs, at least 4 ITIMs, at least 5 ITIMs or at least 6 ITIMs. In some embodiments, the intracellular domain has 1, 2, 3, 4, 5, or 6 ITIMs.

In some embodiments, the polypeptide comprises an intracellular domain comprising at least one ITIM selected from the group of ITIMs consisting of NLYAAV (SEQ ID NO: 117), VTYAEV (SEQ ID NO: 118), VTYAQL (SEQ ID NO: 119), and SIYATL (SEQ ID NO: 120).

In further particular embodiments, the polypeptide comprises an intracellular domain comprising at least two immunoreceptor tyrosine-based inhibitory motifs (ITIMs), wherein each ITIM is independently selected from NLYAAV (SEQ ID NO: 117), VTYAEV (SEQ ID NO: 118), VTYAQL (SEQ ID NO: 119), and SIYATL (SEQ ID NO: 120).

In some embodiments, the intracellular domain comprises both ITIMs NLYAAV (SEQ ID NO: 117) and VTYAEV (SEQ ID NO: 118). In some embodiments, the intracellular domain comprises a sequence at least 95% identical to SEQ ID NO: 121. In some embodiments, the intracellular domain comprises or consists essentially of a sequence identical to SEQ ID NO: 121.

In some embodiments, the intracellular domain comprises both ITIMs VTYAEV (SEQ ID NO: 118) and VTYAQL (SEQ ID NO: 119). In some embodiments, the intracellular domain comprises a sequence at least 95% identical to SEQ ID NO: 122. In some embodiments, the intracellular domain comprises or consists essentially of a sequence identical to SEQ ID NO: 122.

In some embodiments, the intracellular domain comprises both ITIMs VTYAQL (SEQ ID NO: 119) and SIYATL (SEQ ID NO: 120). In some embodiments, the intracellular domain comprises a sequence at least 95% identical to SEQ ID NO: 123. In some embodiments, the intracellular domain comprises or consists essentially of a sequence identical to SEQ ID NO: 123.

In some embodiments, the intracellular domain comprises the ITIMs NLYAAV (SEQ ID NO: 117), VTYAEV (SEQ ID NO: 118), and VTYAQL (SEQ ID NO: 119). In some embodiments, the intracellular domain comprises a sequence at least 95% identical to SEQ ID NO: 124. In some embodiments, the intracellular domain comprises or consists essentially of a sequence identical to SEQ ID NO: 124.

In some embodiments, the intracellular domain comprises the ITIMs VTYAEV (SEQ ID NO: 118), VTYAQL (SEQ ID NO: 119), and SIYATL (SEQ ID NO: 120). In some embodiments, the intracellular domain comprises a sequence at least 95% identical to SEQ ID NO: 125. In some embodiments, the intracellular domain comprises or consists essentially of a sequence identical to SEQ ID NO: 125.

In some embodiments, the intracellular domain comprises the ITIMs NLYAAV (SEQ ID NO: 117), VTYAEV (SEQ ID NO: 118), VTYAQL (SEQ ID NO: 119), and SIYATL (SEQ ID NO: 120). In embodiments, the intracellular domain comprises a sequence at least 95% identical to SEQ ID NO: 126. In some embodiments, the intracellular domain comprises or consists essentially of a sequence identical to SEQ ID NO: 126.

In some embodiments, the intracellular domain comprises a sequence at least 95% identical to the LILRB1 intracellular domain (SEQ ID NO: 131). In some embodiments, the intracellular domain comprises or consists essentially of a sequence identical to the LILRB1 intracellular domain (SEQ ID NO: 131).

LILRB1 intracellular domains or functional variants thereof of the disclosure can have at least 1, at least 2, at least 4, at least 4, at least 5, at least 6, at least 7, or at least 8 ITIMs. In some embodiments, the LILRB1 intracellular domain or functional variant thereof has 2, 3, 4, 5, or 6 ITIMs.

In particular embodiments, the intracellular domain comprises two, three, four, five, or six immunoreceptor tyrosine-based inhibitory motifs (ITIMs), wherein each ITIM is independently selected from NLYAAV (SEQ ID NO: 117), VTYAEV (SEQ ID NO: 118), VTYAQL (SEQ ID NO: 119), and SIYATL (SEQ ID NO: 120).

In particular embodiments, the intracellular domain comprises at least three immunoreceptor tyrosine-based inhibitory motifs (ITIMs), wherein each ITIM is independently selected from NLYAAV (SEQ ID NO: 117), VTYAEV (SEQ ID NO: 118), VTYAQL (SEQ ID NO: 119), and SIYATL (SEQ ID NO: 120).

In particular embodiments, the intracellular domain comprises three immunoreceptor tyrosine-based inhibitory motifs (ITIMs), wherein each ITIM is independently selected from NLYAAV (SEQ ID NO: 117), VTYAEV (SEQ ID NO: 118), VTYAQL (SEQ ID NO: 119), and SIYATL (SEQ ID NO: 120).

In particular embodiments, the intracellular domain comprises four immunoreceptor tyrosine-based inhibitory motifs (ITIMs), wherein each ITIM is independently selected from NLYAAV (SEQ ID NO: 117), VTYAEV (SEQ ID NO: 118), VTYAQL (SEQ ID NO: 119), and SIYATL (SEQ ID NO: 120).

In particular embodiments, the intracellular domain comprises five immunoreceptor tyrosine-based inhibitory motifs (ITIMs), wherein each ITIM is independently selected from NLYAAV (SEQ ID NO: 117), VTYAEV (SEQ ID NO: 118), VTYAQL (SEQ ID NO: 119), and SIYATL (SEQ ID NO: 120).

In particular embodiments, the intracellular domain comprises six immunoreceptor tyrosine-based inhibitory motifs (ITIMs), wherein each ITIM is independently selected from NLYAAV (SEQ ID NO: 117), VTYAEV (SEQ ID NO: 118), VTYAQL (SEQ ID NO: 119), and SIYATL (SEQ ID NO: 120).

In particular embodiments, the intracellular domain comprises at least seven immunoreceptor tyrosine-based inhibitory motifs (ITIMs), wherein each ITIM is independently selected from NLYAAV (SEQ ID NO: 117), VTYAEV (SEQ ID NO: 118), VTYAQL (SEQ ID NO: 119), and SIYATL (SEQ ID NO: 120).

The LILRB1 protein has four immunoglobulin (Ig) like domains termed D1, D2, D3 and D4. In some embodiments, the LILRB1 hinge domain comprises an LILRB1 D3D4 domain or a functional variant thereof. In some embodiments, the LILRB1 D3D4 domain comprises a sequence at least 95%, at least 96%, at least 97%, at least 98%, at least 99% or identical to SEQ ID NO: 127. In some embodiments, the LILRB1 D3D4 domain comprises or consists essentially of SEQ ID NO: 127.

In some embodiments, the polypeptide comprises the LILRB1 hinge domain or functional variant thereof. In embodiments, the LILRB1 hinge domain or functional variant thereof comprises a sequence at least 95%, at least 96%, at least 97%, at least 98%, at least 99% identical or identical to SEQ ID NO: 134, SEQ ID NO: 127, or SEQ ID NO: 128. In embodiments, the LILRB1 hinge domain or functional variant thereof comprises a sequence at least 95% identical to SEQ ID NO: 134, SEQ ID NO: 127, or SEQ ID NO: 128.

In some embodiments, the LILRB1 hinge domain comprises a sequence identical to SEQ ID NO: 134, SEQ ID NO: 127, or SEQ ID NO: 128.

In some embodiments, the LILRB1 hinge domain consists essentially of a sequence identical to SEQ ID NO: 134, SEQ ID NO: 127, or SEQ ID NO: 128.

In some embodiments, the transmembrane domain is a LILRB1 transmembrane domain or a functional variant thereof. In some embodiments, the LILRB1 transmembrane domain or a functional variant thereof comprises a sequence at least 95% identical, at least 96% identical, at least 97% identical, at least 98% identical or at least 99% to SEQ ID NO: 135. In some embodiments, the LILRB1 transmembrane domain or a functional variant thereof comprises a sequence at least 95% identical to SEQ ID NO: 135. In some embodiments, the LILRB1 transmembrane domain comprises a sequence identical to SEQ ID NO: 135. In embodiments, the LILRB1 transmembrane domain consists essentially of a sequence identical to SEQ ID NO: 135.

In some embodiments, the transmembrane domain can be attached to the extracellular region of the second, inhibitory receptor, e.g., the antigen binding domain or ligand binding domain, via a hinge, e.g., a hinge from a human protein. For example, in some embodiments, the hinge can be a human immunoglobulin (Ig) hinge, e.g., an IgG4 hinge, a CD8α hinge or an LILRB1 hinge.

In some embodiments, the second, inhibitory receptor comprises an inhibitory domain. In some embodiments, the second, inhibitory receptor comprises an inhibitory intracellular domain and/or an inhibitory transmembrane domain. In some embodiments, the inhibitory domain is isolated or derived from LILR1B.

Inhibitory Receptors Comprising Combinations of LILRB1 Domains

In some embodiments, the LILRB1-based inhibitory receptors of the disclosure comprise more than one LILRB1 domain or functional equivalent thereof. For example, in some embodiments, the inhibitory receptor comprises an LILRB1 transmembrane domain and intracellular domain, or an LILRB1 hinge domain, transmembrane domain and intracellular domain.

In particular embodiments, the inhibitory receptor comprises an LILRB1 hinge domain or functional fragment thereof, and the LILRB1 transmembrane domain or a functional variant thereof. In some embodiments, the polypeptide comprises a sequence at least 95% identical, at least 96% identical, at least 97% identical, at least 98% identical, at least 99% identical or identical to SEQ ID NO: 129. In some embodiments, the polypeptide comprises a sequence at least 95% identical to SEQ ID NO: 129. In some embodiments, the polypeptide comprises a sequence identical to SEQ ID NO: 129.

In further embodiments, the inhibitory receptor comprises: the LILRB1 transmembrane domain or a functional variant thereof, and an LILRB1 intracellular domain and/or an intracellular domain comprising at least one immunoreceptor tyrosine-based inhibitory motif (ITIM), wherein the ITIM is selected from NLYAAV (SEQ ID NO: 117), VTYAEV (SEQ ID NO: 118), VTYAQL (SEQ ID NO: 119), and SIYATL (SEQ ID NO: 120). In some embodiments, the polypeptide comprises the LILRB1 transmembrane domain or a functional variant thereof, and an LILRB1 intracellular domain and/or an intracellular domain comprising at least two ITIM, wherein each ITIM is independently selected from NLYAAV (SEQ ID NO: 117), VTYAEV (SEQ ID NO: 118), VTYAQL (SEQ ID NO: 119), and SIYATL (SEQ ID NO: 120).

In some embodiments, the inhibitory receptor comprises a LILRB1 transmembrane domain and intracellular domain. In some embodiments, the polypeptide comprises a sequence at least 95% identical, at least 96% identical, at least 97% identical, at least 98% identical, at least 99% identical or identical to SEQ ID NO: 130. In some embodiments, the polypeptide comprises a sequence at least 95% identical to SEQ ID NO: 130. In some embodiments, the polypeptide comprises a sequence identical to SEQ ID NO: 130.

In preferred embodiments, the inhibitory receptor comprises: an LILRB1 hinge domain or functional variant thereof; an LILRB1 transmembrane domain or a functional variant thereof; and an LILRB1 intracellular domain and/or an intracellular domain comprising at least two immunoreceptor tyrosine-based inhibitory motifs (ITIMs), wherein each ITIM is independently selected from LYAAV (SEQ ID NO: 117), VTYAE (SEQ ID NO: 118), VTYAQL (SEQ ID NO: 119), and SIYATL (SEQ ID NO: 11).

In some embodiments, the inhibitory receptor comprises a sequence at least 95% identical to SEQ ID NO: 132 or SEQ ID NO: 133, or at least 99% identical to SEQ ID NO: 132 or SEQ ID NO: 133, or identical to SEQ ID NO: 132 or SEQ ID NO: 133.

In some embodiments, the polypeptide comprises a sequence at least 99% identical to SEQ ID NO: 129, or at least 99% identical to SEQ ID NO: 129, or identical to SEQ ID NO: 129.

In some embodiments, the polypeptide comprises a sequence at least 99% identical to SEQ ID NO: 130, or at least 99% identical to SEQ ID NO: 130, or identical to SEQ ID NO: 130.

TABLE 7

Polypeptide sequences for illustrative LILRB1-based inhibitory receptors

| Name | Sequence |
|---|---|
| LILRB1 | MTPILTVLICLGLSLGPRTHVQAGHLPKPTLWAEPGSVITQ<br>GSPVTLRCQGGQETQEYRLYREKKTALWITRIPQELVKKG<br>QFPIPSITWEHAGRYRCYYGSDTAGRSESSDPLELVVTGA<br>YIKPTLSAQPSPVVNSGGNVILQCDSQVAFDGFSLCKEGED<br>EHPQCLNSQPHARGSSRAIFSVGPVSPSRRWWYRCYAYDS<br>NSPYEWSLPSDLLELLVLGVSKKPSLSVQPGPIVAPEETLT<br>LQCGSDAGYNRFVLYKDGERDFLQLAGAQPQAGLSQANF<br>TLGPVSRSYGGQYRCYGAHNLSSEWSAPSDPLDILIAGQF<br>YDRVSLSVQPGPTVASGENVTLLCQSQGWMQTFLLTKEG<br>AADDPWRLRSTYQSQKYQAEFPMGPVTSAHAGTYRCYG<br>SQSSKPYLLTHPSDPLELVVSGPSGGPSSPTTGPTSTSGPE<br>DQPLTPTGSDPQSGLGRHLGVVIGILVAVILLLLLLLLFLI<br>LRHRRQGKHWTSTQRKADFQHPAGAVGPEPTDRGLQWR<br>SSPAADAQEENLYAAVKHTQPEDGVEMDTRSPHDEDPQA<br>VTYAEVKHSRPRREMASPPSPLSGEFLDTKDRQAEEDRQ<br>MDTEAAASEAPQDVTYAQLHSLTLRREATEPPPSQEGPSP<br>AVPSIYATLAIHPSQEGPSPAVPSIYATLAIH<br>SEQ ID NO: 115 |
| LILRB1 hinge-<br>transmembrane-<br>intracellular domain | YGSQSSKPYLLTHPSDPLELVVSGPSGGPSSPTTGPTSTSG<br>PEDQPLTPTGSDPQSGLGRHLGVVIGILVAVILLLLLLLL<br>FLILRHRRQGKHWTSTQRKADFQHPAGAVGPEPTDRGLQ<br>WRSSPAADAQEENLYAAVKHTQPEDGVEMDTRSPHDEDP<br>QAVTYAEVKHSRPRREMASPPSPLSGEFLDTKDRQAEEDR<br>QMDTEAAASEAPQDVTYAQLHSLTLRREATEPPPSQEGPS<br>PAVPSIYATLAIH<br>SEQ ID NO: 132 |
| LILRB1 hinge-<br>transmembrane-<br>intracellular domain<br>(w/o YGSQSSKPYLLTHPSD<br>PLEL) | VVSGPSGGPSSPTTGPTSTSGPEDQPLTPTGSDPQSGLGRH<br>LGVVIGILVAVILLLLLLLLFLILRHRRQGKHWTSTQRK<br>ADFQHPAGAVGPEPTDRGLQWRSSPAADAQEENLYAAV<br>KHTQPEDGVEMDTRSPHDEDPQAVTYAEVKHSRPRREMA<br>SPPSPLSGEFLDTKDRQAEEDRQMDTEAAASEAPQDVTYA<br>QLHSLTLRREATEPPPSQEGPSPAVPSIYATLAIH<br>SEQ ID NO: 133 |
| LILRB1 hinge domain | YGSQSSKPYLLTHPSDPLELVVSGPSGGPSSPTTGPTSTSG<br>PEDQPLTPTGSDPQSGLGRHLG<br>SEQ ID NO: 134 |
| LILRB1 transmembrane<br>domain | VVIGILVAVILLLLLLLLFLIL<br>SEQ ID NO: 135 |
| LILRB1 intracellular<br>domain | RHRRQGKHWTSTQRKADFQHPAGAVGPEPTDRGLQWRS<br>SPAADAQEENLYAAVKHTQPEDGVEMDTRSPHDEDPQAV<br>TYAEVKHSRPRREMASPPSPLSGEFLDTKDRQAEEDRQM<br>DTEAAASEAPQDVTYAQLHSLTLRREATEPPPSQEGPSPA<br>VPSIYATLAIH<br>SEQ ID NO: 131 |
| ITIM1 | NLYAAV<br>SEQ ID NO: 117 |
| ITIM2 | VTYAEV<br>SEQ ID NO: 118 |
| ITIM3 | VTYAQL<br>SEQ ID NO: 119 |
| ITIM4 | SIYATL<br>SEQ ID NO: 120 |
| ITIM1-2 | NLYAAVKHTQPEDGVEMDTRSPHDEDPQAVTYAEV<br>SEQ ID NO: 121 |
| ITIM2-3 | VTYAEVKHSRPRREMASPPSPLSGEFLDTKDRQAEEDRQ<br>MDTEAAASEAPQDVTYAQL<br>SEQ ID NO: 122 |
| ITIM3-4 | VTYAQLHSLTLRREATEPPPSQEGPSPAVPSIYATL<br>SEQ ID NO: 123 |

TABLE 7-continued

Polypeptide sequences for illustrative LILRB1-based inhibitory receptors

| Name | Sequence |
|---|---|
| ITIM1-3 | NLYAAVKHTQPEDGVEMDTRSPHDEDPQAVTYAEVKHSRPRREMASPPSPLSGEFLDTKDRQAEEDRQMDTEAAASEAPQDVTYAQL<br>SEQ ID NO: 124 |
| ITIM2-4 | VTYAEVKHSRPRREMASPPSPLSGEFLDTKDRQAEEDRQMDTEAAASEAPQDVTYAQLHSLTLRREATEPPPSQEGPSPAVPSIYATL<br>SEQ ID NO: 125 |
| ITIM1-4 | NLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATL<br>SEQ ID NO: 126 |
| D3D4 domain | YGSQSSKPYLLTHPSDPLEL<br>SEQ ID NO: 127 |
| Short hinge | VVSGPSGGPSSPTTGPTSTSGPEDQPLTPTGSDPQSGLGRHLG<br>SEQ ID NO: 128 |
| Hinge (iTIM hinge) | YGSQSSKPYLLTHPSDPLELVVSGPSGGPSSPTTGPTSTSGPEDQPLTPTGSDPQSGLGRHLGV<br>SEQ ID NO: 483 |
| Short hinge 2 | VVSGPSGGPSSPTTGPTSTSGPEDQPLTPTGSDPQSGLGRHLGV<br>SEQ ID NO: 484 |
| Long hinge 1 | AGSGGSGGSGGSPVPSTPPTPSPSTPPTPSPSGGSGNSSGSGGSPVPSTPPTPSPSTPPTPSPSASV<br>SEQ ID NO: 485 |
| Long hinge 2 | AGSGGSGGSGGSPVPSTPPTNSSSTPPTPSPSPVPSTPPTNSSSTPPTPSPSPVPSTPPTNSSSTPPTPSPSASV<br>SEQ ID NO: 486 |
| 2x short hinge | VVSGPSGGPSSPTTGPTSTSGPEDQPLTPTGSDPQSGLGRHVVSGPSGGPSSPTTGPTSTSGPEDQPLTPTGSDPQSGLGRHLGV<br>SEQ ID NO: 487 |
| Hinge (truncated) | TTGPTSTSGPEDQPLTPTGSDPQSGLGRHLGV<br>SEQ ID NO: 488 |
| Hinge-transmembrane | YGSQSSKPYLLTHPSDPLELVVSGPSGGPSSPTTGPTSTSGPEDQPLTPTGSDPQSGLGRHLGVVIGILVAVILLLLLLLLFLIL<br>SEQ ID NO: 129 |
| Transmembrane-intracellular domain. | VVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH<br>SEQ ID NO: 130 |

Polynucleotides and Vectors

The disclosure provides polynucleotides encoding the sequence(s) of the first and second receptors of the disclosure. The disclosure provides immune cells comprising the polynucleotides and vectors described herein.

In some embodiments, the sequence of the first and/or second receptor is operably linked to a promoter. In some embodiments, the sequence encoding the first receptor is operably linked to a first promoter, and the sequence encoding the second receptor is operably linked to a second promoter.

The disclosure provides vectors comprising the polynucleotides described herein.

In some embodiments, the first receptor is encoded by a first vector and the second receptor is encoded by a second vector. In some embodiments, both receptors are encoded by a single vector. In some embodiments, the first and/or second vector comprises an shRNA, for example a B2M shRNA.

In some embodiments, both receptors are encoded by a single vector. In some embodiments the vector comprises an shRNA, for example a B2M shRNA.

In some embodiments, the first and second receptors are encoded by a single vector. Methods of encoding multiple polypeptides using a single vector will be known to persons of ordinary skill in the art, and include, inter alia, encoding multiple polypeptides under control of different promoters, or, if a single promoter is used to control transcription of multiple polypeptides, use of sequences encoding internal ribosome entry sites (IRES) and/or self-cleaving peptides. Exemplary self-cleaving peptides include T2A, P2A, E2A and F2A self-cleaving peptides. In some embodiments, the T2A self-cleaving peptide comprises a sequence of EGRGSLLTCGDVEENPGP (SEQ ID NO: 489). In some embodiments, the P2A self-cleaving peptide comprises a sequence of ATNFSLLKQAGDVEENPGP (SEQ ID NO: 186). In some embodiments, the E2A self-cleaving peptide comprises a sequence of QCTNYALLKLAGDVESNPGP (SEQ ID NO: 490). In some embodiments, the F2A self-cleaving peptide comprises a sequence of VKQTLNFDLLKLAGDVESNPGP (SEQ ID NO: 491). In some embodiments, the T2A self-cleaving peptide comprises a sequence of EGRGSLLTCGDVEENPGP (SEQ ID NO: 489). Any of the foregoing can also include an N terminal GSG linker. For example, a T2A self-cleaving peptide can also comprise a sequence of GSGEGRGSLLTCGDVEENPGP (SEQ ID NO: 181), which can be encoded by a sequence of (SEQ ID NO: 492)
GGATCCGGAGAGGGCAGAGGCAGCCTGCTGACATGTGGCGACGTGGAAGA

GAACCCTGGCCCC.

In some embodiments, the vector is an expression vector, i.e. for the expression of the first and/or second receptor in a suitable cell.

Vectors derived from retroviruses such as the lentivirus are suitable tools to achieve long-term gene transfer since they allow long-term, stable integration of a transgene and its propagation in daughter cells. Lentiviral vectors have the added advantage over vectors derived from onco-retroviruses such as murine leukemia viruses in that they can transduce non-proliferating cells, such as hepatocytes. They also have the added advantage of low immunogenicity.

The expression of natural or synthetic nucleic acids encoding receptors is typically achieved by operably linking a nucleic acid encoding the receptor or portions thereof to a promoter, and incorporating the construct into an expression vector. The vectors can be suitable for replication and integration eukaryotes. Typical cloning vectors contain transcription and translation terminators, initiation sequences, and promoters useful for regulation of the expression of the desired nucleic acid sequence.

The polynucleotides encoding the receptors can be cloned into a number of types of vectors. For example, the polynucleotides can be cloned into a vector including, but not limited to a plasmid, a phagemid, a phage derivative, an animal virus, and a cosmid. Vectors of particular interest include expression vectors, replication vectors, probe generation vectors, and sequencing vectors.

Further, the expression vector may be provided to cells, such as immune cells, in the form of a viral vector. Viral vector technology is well known in the art and is described, for example, in Sambrook et al. (2001, Molecular Cloning: A Laboratory Manual, Cold Spring Harbor Laboratory, New York), and in other virology and molecular biology manuals. Viruses, which are useful as vectors include, but are not limited to, retroviruses, adenoviruses, adeno-associated viruses, herpes viruses, and lentiviruses. In general, a suitable vector contains an origin of replication functional in at least one organism, a promoter sequence, convenient restriction endonuclease sites, and one or more selectable markers, (e.g., WO 01/96584; WO 01/29058; and U.S. Pat. No. 6,326,193).

A number of viral based systems have been developed for gene transfer into mammalian cells. For example, retroviruses provide a convenient platform for gene delivery systems. A selected gene can be inserted into a vector and packaged in retroviral particles using techniques known in the art. The recombinant virus can then be isolated and delivered to cells of the subject either in vivo or ex vivo. A number of retroviral systems are known in the art. In some embodiments, adenovirus vectors are used. A number of adenovirus vectors are known in the art. In one embodiment, lentivirus vectors are used.

Additional promoter elements, e.g., enhancers, regulate the frequency of transcriptional initiation. Typically, these are located in the region 30-110 basepairs (bp) upstream of the start site, although a number of promoters have recently been shown to contain functional elements downstream of the start site as well. The spacing between promoter elements frequently is flexible, so that promoter function is preserved when elements are inverted or moved relative to one another. In the thymidine kinase (tk) promoter, the spacing between promoter elements can be increased to 50 bp apart before activity begins to decline. Depending on the promoter, it appears that individual elements can function either cooperatively or independently to activate transcription.

One example of a suitable promoter is the immediate early cytomegalovirus (CMV) promoter sequence. This promoter sequence is a strong constitutive promoter sequence capable of driving high levels of expression of any polynucleotide sequence operatively linked thereto. Another example of a suitable promoter is Elongation Growth Factor-1α (EF-1α). However, other constitutive promoter sequences may also be used, including, but not limited to the simian virus 40 (SV40) early promoter, mouse mammary tumor virus (MMTV), human immunodeficiency virus (HIV) long terminal repeat (LTR) promoter, MoMuLV promoter, an avian leukemia virus promoter, an Epstein-Barr virus immediate early promoter, a Rous sarcoma virus promoter, a U6 promoter, as well as human gene promoters such as, but not limited to, the actin promoter, the myosin promoter, the hemoglobin promoter, and the creatine kinase promoter. Further, the disclosure should not be limited to the use of constitutive promoters. Inducible promoters are also contemplated as part of the disclosure. The use of an inducible promoter provides a molecular switch capable of turning on expression of the polynucleotide sequence which it is operatively linked when such expression is desired, or turning off the expression when expression is not desired. Examples of inducible promoters include, but are not limited to a metallothionine promoter, a glucocorticoid promoter, a progesterone promoter, and a tetracycline promoter.

In order to assess the expression of a receptor, the expression vector to be introduced into a cell can also contain either a selectable marker gene or a reporter gene or both to facilitate identification and selection of expressing cells from the population of cells sought to be transfected or infected through viral vectors. In other aspects, the selectable marker may be carried on a separate piece of DNA and used in a co-transfection procedure. Both selectable markers and reporter genes may be flanked with appropriate regulatory sequences to enable expression in the host cells. Useful selectable markers include, for example, antibiotic-resistance genes, such as neo and the like.

Reporter genes are used for identifying potentially transfected or transduced cells and for evaluating the functionality of regulatory sequences. In general, a reporter gene is a gene that is not present in or expressed by the recipient organism or tissue and that encodes a polypeptide whose expression is manifested by some easily detectable property, e.g., enzymatic activity. Expression of the reporter gene is assayed at a suitable time after the DNA has been introduced into the recipient cells. Suitable reporter genes may include genes encoding luciferase, beta-galactosidase, chloramphenicol acetyl transferase, secreted alkaline phosphatase, or the green fluorescent protein gene (e.g., Ui-Tei et al., 2000 FEBS Letters 479: 79-82). Suitable expression systems are well known and may be prepared using known techniques or obtained commercially. In general, the construct with the minimal 5' flanking region showing the highest level of expression of reporter gene is identified as the promoter. Such promoter regions may be linked to a reporter gene and used to evaluate agents for the ability to modulate promoter-driven transcription.

Methods of introducing and expressing genes into a cell are known in the art. In the context of an expression vector, the vector can be readily introduced into a host cell, e.g., mammalian, bacterial, yeast, or insect cell by any method in the art. For example, the expression vector can be transferred into a host cell by physical, chemical, or biological means.

Physical methods for introducing a polynucleotide into a host cell include calcium phosphate precipitation, lipofection, particle bombardment, microinjection, electroporation, and the like. Methods for producing cells comprising vectors and/or exogenous nucleic acids are well-known in the art. See, for example, Sambrook et al. (2001, Molecular Cloning: A Laboratory Manual, Cold Spring Harbor Laboratory, New York). One method for the introduction of a polynucleotide into a host cell is calcium phosphate transfection.

Biological methods for introducing a polynucleotide of interest into a host cell include the use of DNA and RNA vectors. Viral vectors, and especially retroviral vectors, have become the most widely used method for inserting genes into mammalian, e.g., human cells. Other viral vectors can be derived from lentivirus, poxviruses, herpes simplex virus I, adenoviruses and adeno-associated viruses, and the like. See, for example, U.S. Pat. Nos. 5,350,674 and 5,585,362.

Chemical means for introducing a polynucleotide into a host cell include colloidal dispersion systems, such as macromolecule complexes, nanocapsules, microspheres, beads, and lipid-based systems including oil-in-water emulsions, micelles, mixed micelles, and liposomes. An exemplary colloidal system for use as a delivery vehicle in vitro and in vivo is a liposome (e.g., an artificial membrane vesicle).

Regardless of the method used to introduce exogenous nucleic acids into a host cell or otherwise expose a cell to the inhibitor of the present disclosure, in order to confirm the presence of the recombinant DNA sequence in the host cell, a variety of assays may be performed. Such assays include, for example, "molecular biological" assays well known to those of skill in the art, such as Southern and Northern blotting, RT-PCR and PCR; "biochemical" assays, such as detecting the presence or absence of a particular peptide, e.g., by immunological means (ELISAs and Western blots) or by assays described herein to identify agents falling within the scope of the disclosure.

Immune Cells

The disclosure provides immune cells comprising the receptors, vectors and polynucleotides described herein.

In some embodiments, the immune cells comprise: (a) first receptor, comprising a first extracellular ligand binding domain specific to a target antigen selected from: (i) a cancer cell-specific antigen, or a peptide antigen thereof in a complex with a major histocompatibility complex class I (MHC-I); or (ii) CEA cell adhesion molecule 5 (CEA), or a peptide antigen thereof in a complex with a major histocompatibility complex class I (MHC-I); and (b) a second receptor, comprising a second extracellular ligand binding specific to anon-target antigen selected from TNFRSF11, ACHRB, ITGAE, TRPV1, and SREC, or an antigen peptide thereof in a complex with a major histocompatibility complex class I (MHC-I), wherein the non-target antigen comprises a polymorphism. In some embodiments, the first receptor is a CAR or TCR. In some embodiments, the second receptor is an inhibitory receptor, such as an inhibitory chimeric antigen receptor or TCR.

As used herein, the term "immune cell" refers to a cell involved in the innate or adaptive (acquired) immune systems. Exemplary innate immune cells include phagocytic cells such as neutrophils, monocytes and macrophages, Natural Killer (NK) cells, polymophonuclear leukocytes such as neutrophils eosinophils and basophils and mononuclear cells such as monocytes, macrophages and mast cells. Immune cells with roles in acquired immunity include lymphocytes such as T-cells and B-cells.

The disclosure provides immune cells comprising a first receptor comprising a sequence of SEQ ID NO: 52, and second receptor comprising a sequence of SEQ ID NO: 164, or sequences having at least 90%, at least 95%, at least 97% or at least 99% identity thereto. In some embodiments, the immune cells comprise an shRNA encoded by a sequence comprising GCACTCAAAGCTTGTTAA-GATCGAAATCTTAACAAGCTTTGAGTGC (SEQ ID NO: 179) or a sequence having at least 80%, at least 90%, or at least 95% identity thereto. In some embodiments, the immune cells comprise first receptor comprising a sequence of SEQ ID NO: 52, a second receptor comprising a sequence of SEQ ID NO: 164, and a sequence encoding an shRNA comprising a sequence of SEQ ID NO: 179. In some embodiments, the first receptor and second receptor are encoded by a single polynucleotide, and wherein the sequences encoding the first and second receptors are separated by a sequence encoding a self-cleaving polypeptide. In some embodiments, the self-cleaving polypeptide comprises a T2A self-cleaving polypeptide comprising a sequence of GSGEGRGSLLTCGDVEENPGP (SEQ ID NO: 181).

The disclosure provides immune cells comprising a polypeptide comprising a sequence of SEQ ID NO: 141, or a sequence having at least 80%, at least 90%, or at least 95% identity thereto. In some embodiments, the polypeptide comprises SEQ ID NO: 141.

The disclosure provides immune cells comprising a polynucleotide comprising a sequence of SEQ ID NO: 142, or a sequence having at least 80%, at least 90%, or at least 95% identity thereto. In some embodiments, the polynucleotide comprises SEQ ID NO: 142.

As used herein, a "T-cell" refers to a type of lymphocyte that originates from a bone marrow precursor that develops in the thymus gland. There are several distinct types of T-cells which develop upon migration to the thymus, which include, helper CD4+ T-cells, cytotoxic CD8+ T cells, memory T cells, regulatory CD4+ T-cells and stem memory T-cells. Different types of T-cells can be distinguished by the ordinarily skilled artisan based on their expression of markers. Methods of distinguishing between T-cell types will be readily apparent to the ordinarily skilled artisan.

In some embodiments, the first receptor and the second receptor together specifically activate the immune cell in the presence of the target cell.

In some embodiments, the immune cell is selected form the group consisting of T cells, B cells and Natural Killer (NK) cells. In some embodiments, the immune cell is a gamma delta (γδ) T cell. In some embodiments, the immune cell is an invariant T cell. In some embodiments, the immune cell is an invariant natural killer T cell (iNKT cell). In some embodiments, the immune cell is a T cell, an NK cell or a macrophage. In some embodiments, the immune cell is a B cell. In some embodiments, the immune cell is a Natural Killer (NK) cell. In some embodiments, the immune cell is CD8−. In some embodiments, the immune cell is CD8+. In some embodiments, the immune cell is CD4+. In some embodiments, the immune cell is CD4−. In some embodiments, the immune cell is CD8−/CD4+. In some embodiments, the immune cell is a CD8+ CD4− T cell.

In some embodiments, the immune cell is non-natural. In some embodiments, the immune cell is isolated.

Methods transforming populations of immune cells, such as T cells, with the vectors of the instant disclosure will be readily apparent to the person of ordinary skill in the art. For example, CD3+ T cells can be isolated from PBMCs using a CD3+ T cell negative isolation kit (Miltenyi), according to manufacturer's instructions. T cells can be cultured at a density of $1 \times 10^6$ cells/mL in X-Vivo 15 media supplemented with 5% human A/B serum and 1% Pen/strep in the presence of CD3/28 Dynabeads (1:1 cell to bead ratio) and 300 Units/mL of IL-2 (Miltenyi). After 2 days, T cells can be transduced with viral vectors, such as lentiviral vectors using methods known in the art. In some embodiments, the viral vector is transduced at a multiplicity of infection (MOI) of 5. Cells can then be cultured in IL-2 or other cytokines such as combinations of IL-7/15/21 for an additional 5 days prior to enrichment. Methods of isolating and culturing other populations of immune cells, such as B cells, or other populations of T cells, will be readily apparent to the person of ordinary skill in the art. Although this method outlines a potential approach it should be noted that these methodologies are rapidly evolving. For example excellent viral transduction of peripheral blood mononuclear cells can be achieved after 5 days of growth to generate a >99% CD3+ highly transduced cell population.

Methods of activating and culturing populations of T cells comprising the TCRs, CARs, inhibitory receptors receptors or vectors encoding same, will be readily apparent to the person of ordinary skill in the art.

Whether prior to or after genetic modification of T cells to express a TCR, the T cells can be activated and expanded generally using methods as described, for example, in U.S. Pat. Nos. 6,352,694; 6,534,055; 6,905,680; 6,692,964; 5,858,358; 6,887,466; 6,905,681; 7,144,575; 7,067,318; 7,172,869; 7,232,566; 7,175,843; 5,883,223; 6,905,874; 6,797,514; 6,867,041, 10,040,846; and U.S. Pat. Appl. Pub. No. 2006/0121005.

In some embodiments, T cells of the instant disclosure are expanded and activated in vitro. Generally, the T cells of the instant disclosure are expanded in vitro by contact with a surface having attached thereto an agent that stimulates a CD3/TCR complex associated signal and a ligand that stimulates a co-stimulatory molecule on the surface of the T cells. In particular, T cell populations may be stimulated as described herein, such as by contact with an anti-CD3 antibody. For co-stimulation of an accessory molecule on the surface of the T cells, a ligand that binds the accessory molecule is used. For example, a population of T cells can be contacted with an anti-CD3 antibody and an anti-CD28 antibody, under conditions appropriate for stimulating proliferation of the T cells. To stimulate proliferation of either CD4+ T cells or CD8+ T cells, an anti-CD3 antibody and an anti-CD28 antibody can be used. Examples of an anti-CD28 antibody include 9.3, B-T3, XR-CD28 (Diaclone, Besançon, France) can be used as can other methods commonly known in the art (Berg et al., Transplant Proc. 30(8):3975-3977, 1998; Haanen et al., J. Exp. Med. 190(9):13191328, 1999; Garland et al., J. Immunol Meth. 227(1-2):53-63, 1999).

In some embodiments, the primary stimulatory signal and the co-stimulatory signal for the T cell may be provided by different protocols. For example, the agents providing each signal may be in solution or coupled to a surface. When coupled to a surface, the agents may be coupled to the same surface (i.e., in "cis" formation) or to separate surfaces (i.e., in "trans" formation). Alternatively, one agent may be coupled to a surface and the other agent in solution. In some embodiments, the agent providing the co-stimulatory signal is bound to a cell surface and the agent providing the primary activation signal is in solution or coupled to a surface. In certain embodiments, both agents can be in solution. In another embodiment, the agents may be in soluble form, and then cross-linked to a surface, such as a cell expressing Fc receptors or an antibody or other binding agent which will bind to the agents. In this regard, see for example, U.S. Patent Application Publication Nos. 20040101519 and 20060034810 for artificial antigen presenting cells (aAPCs) that are contemplated for use in activating and expanding T cells in the present disclosure.

In some embodiments, the two agents are immobilized on beads, either on the same bead, i.e., "cis," or to separate beads, i.e., "trans." By way of example, the agent providing the primary activation signal is an anti-CD3 antibody or an antigen-binding fragment thereof and the agent providing the co-stimulatory signal is an anti-CD28 antibody or antigen-binding fragment thereof; and both agents are co-immobilized to the same bead in equivalent molecular amounts. In one embodiment, a 1:1 ratio of each antibody bound to the beads for CD4+ T cell expansion and T cell growth is used. In some embodiments, the ratio of CD3:CD28 antibody bound to the beads ranges from 100:1 to 1:100 and all integer values there between. In one aspect of the present disclosure, more anti-CD28 antibody is bound to the particles than anti-CD3 antibody, i.e., the ratio of CD3:CD28 is less than one. In certain embodiments of the disclosure, the ratio of anti CD28 antibody to anti CD3 antibody bound to the beads is greater than 2:1.

Ratios of particles to cells from 1:500 to 500:1 and any integer values in between may be used to stimulate T cells or other target cells. As those of ordinary skill in the art can readily appreciate, the ratio of particles to cells may depend on particle size relative to the target cell. For example, small sized beads could only bind a few cells, while larger beads could bind many. In certain embodiments the ratio of cells to particles ranges from 1:100 to 100:1 and any integer values in-between and in further embodiments the ratio comprises 1:9 to 9:1 and any integer values in between, can also be used to stimulate T cells. In some embodiments, a ratio of 1:1 cells to beads is used. One of skill in the art will appreciate that a variety of other ratios may be suitable for use in the present disclosure. In particular, ratios will vary depending on particle size and on cell size and type.

In further embodiments of the present disclosure, the cells, such as T cells, are combined with agent-coated beads, the beads and the cells are subsequently separated, and then the cells are cultured. In an alternative embodiment, prior to culture, the agent-coated beads and cells are not separated but are cultured together. In a further embodiment, the beads and cells are first concentrated by application of a force, such as a magnetic force, resulting in increased ligation of cell surface markers, thereby inducing cell stimulation.

By way of example, cell surface proteins may be ligated by allowing paramagnetic beads to which anti-CD3 and anti-CD28 are attached to contact the T cells. In one embodiment the cells (for example, CD4+ T cells) and beads (for example, DYNABEADS CD3/CD28 T paramagnetic beads at a ratio of 1:1) are combined in a buffer. Again, those of ordinary skill in the art can readily appreciate any cell concentration may be used. In certain embodiments, it may be desirable to significantly decrease the volume in which particles and cells are mixed together (i.e., increase the concentration of cells), to ensure maximum contact of cells and particles. For example, in one embodiment, a concentration of about 2 billion cells/ml is used. In another embodiment, greater than 100 million cells/ml is used. In a further embodiment, a concentration of cells of 10, 15, 20, 25, 30, 35, 40, 45, or 50 million cells/ml is used. In yet another embodiment, a concentration of cells from 75, 80, 85, 90, 95, or 100 million cells/ml is used. In further embodiments, concentrations of 125 or 150 million cells/ml can be used. In some embodiments, cells that are cultured at a density of $1 \times 10^6$ cells/mL are used.

In some embodiments, the mixture may be cultured for several hours (about 3 hours) to about 14 days or any hourly integer value in between. In another embodiment, the beads and T cells are cultured together for 2-3 days. Conditions appropriate for T cell culture include an appropriate media (e.g., Minimal Essential Media or RPMI Media 1640 or, X-vivo 15, (Lonza)) that may contain factors necessary for proliferation and viability, including serum (e.g., fetal bovine or human serum), interleukin-2 (IL-2), insulin, IFN-γ, IL-4, IL-7, GM-CSF, IL-10, IL-12, IL-15, TGFβ, and TNF-α or any other additives for the growth of cells known to the skilled artisan. Other additives for the growth of cells include, but are not limited to, surfactant, plasmanate, and reducing agents such as N-acetyl-cysteine and 2-mercaptoethanol. Media can include RPMI 1640, AIM-V, DMEM, MEM, α-MEM, F-12, X-Vivo 15, and X-Vivo 20, Optimizer, with added amino acids, sodium pyruvate, and vitamins, either serum-free or supplemented with an appropriate amount of serum (or plasma) or a defined set of hormones, and/or an amount of cytokine(s) sufficient for the growth and expansion of T cells. In some embodiments, the media comprises X-VIVO-15 media supplemented with 5% human A/B serum, 1% penicillin/streptomycin (pen/strep) and 300 Units/ml of IL-2 (Miltenyi).

The T cells are maintained under conditions necessary to support growth, for example, an appropriate temperature (e.g., 37° C.) and atmosphere (e.g., air plus 5% CO2).

In some embodiments, the T cells comprising TCRs, CARs and inhibitory receptors of the disclosure are autologous. Prior to expansion and genetic modification, a source of T cells is obtained from a subject. Immune cells such as T cells can be obtained from a number of sources, including peripheral blood mononuclear cells, bone marrow, lymph node tissue, cord blood, thymus tissue, tissue from a site of infection, ascites, pleural effusion, spleen tissue, and tumors. In certain embodiments of the present disclosure, any number of T cell lines available in the art, may be used. In certain embodiments of the present disclosure, T cells can be obtained from a unit of blood collected from a subject using any number of techniques known to the skilled artisan, such as Ficoll™ separation.

In some embodiments, cells from the circulating blood of an individual are obtained by apheresis. The apheresis product typically contains lymphocytes, including T cells, monocytes, granulocytes, B cells, other nucleated white blood cells, red blood cells, and platelets. In some embodiments, the cells collected by apheresis may be washed to remove the plasma fraction and to place the cells in an appropriate buffer or media for subsequent processing steps. In some embodiments, the cells are washed with phosphate buffered saline (PBS). In alternative embodiments, the wash solution lacks calcium and may lack magnesium or may lack many if not all divalent cations. As those of ordinary skill in the art would readily appreciate a washing step may be accomplished by methods known to those in the art, such as by using a semi-automated "flow-through" centrifuge (for example, the Cobe 2991 cell processor, the Baxter Cyto-Mate, or the Haemonetics Cell Saver 5) according to the manufacturer's instructions. After washing, the cells may be resuspended in a variety of biocompatible buffers, such as, for example, Ca2+-free, Mg2+-free PBS, PlasmaLyte A, or other saline solution with or without buffer. Alternatively, the undesirable components of the apheresis sample may be removed and the cells directly resuspended in culture media.

In some embodiments, immune cells such as T cells are isolated from peripheral blood lymphocytes by lysing the red blood cells and depleting the monocytes, for example, by centrifugation through a PERCOLL™ gradient or by counterflow centrifugal elutriation. Specific subpopulations of immune cells, such as T cells, B cells, or CD4+ T cells can be further isolated by positive or negative selection techniques. For example, in one embodiment, T cells are isolated by incubation with anti-CD4-conjugated beads, for a time period sufficient for positive selection of the desired T cells.

Enrichment of an immune cell population, such as a T cell population, by negative selection can be accomplished with a combination of antibodies directed to surface markers unique to the negatively selected cells. One method is cell sorting and/or selection via negative magnetic immune-adherence or flow cytometry that uses a cocktail of monoclonal antibodies directed to cell surface markers present on the cells negatively selected. For example, to enrich for CD4+ cells by negative selection, a monoclonal antibody cocktail typically includes antibodies to CD 14, CD20, CD 11b, CD 16, HLA-DR, and CD8.

For isolation of a desired population of immune cells by positive or negative selection, the concentration of cells and surface (e.g., particles such as beads) can be varied. In certain embodiments, it may be desirable to significantly decrease the volume in which beads and cells are mixed together (i.e., increase the concentration of cells), to ensure maximum contact of cells and beads.

In some embodiments, the cells may be incubated on a rotator for varying lengths of time at varying speeds at either 2-10° C. or at room temperature.

T cells for stimulation, or PBMCs from which immune cells such as T cells are isolated, can also be frozen after a washing step. Wishing not to be bound by theory, the freeze and subsequent thaw step provides a more uniform product by removing granulocytes and to some extent monocytes in the cell population. After the washing step that removes plasma and platelets, the cells may be suspended in a freezing solution. While many freezing solutions and parameters are known in the art and will be useful in this context, one method involves using PBS containing 20% DMSO and 8% human serum albumin, or culture media containing 10% Dextran 40 and 5% Dextrose, 20% Human Serum Albumin and 7.5% DMSO, or 31.25% Plasmalyte-A, 31.25% Dextrose 5%, 0.45% NaCl, 10% Dextran 40 and 5% Dextrose, 20% Human Serum Albumin, and 7.5% DMSO or other suitable cell freezing media containing for example, Hespan and PlasmaLyte A, the cells then are frozen to −80° C. at a rate of 1° per minute and stored in the vapor phase of a liquid nitrogen storage tank. Other methods of controlled freezing may be used as well as uncontrolled freezing immediately at −20° C. or in liquid nitrogen.

The disclosure provides an immune cell expressing the activator and/or blocker receptors described herein, wherein the immune cell has reduced expression and/or function the major histocompatibility (MHC) class I complex.

In some embodiments, the immune cell is autologous. For example, the immune cells is isolated or derived from same subject who will receive the cell as part of a therapeutic regimen. It can be advantageous to modify autologous immune cells to have reduced expression and/or function of MHC class I with the blocker receptor is specific to an MHC class I antigen. Without wishing to be bound by theory, modification of autologous immune cells to have reduced expression and/or function of MHC class I reduces binding of the blocker receptor by MHC class I expressed by the immune cells, either in cis or in trans.

In some embodiments, the immune cell is all allogeneic. Allogeneic immune cells can be derived from a donor other than the subject to which the immune cells will be administered. Allogeneic immune cells have been commonly referred to in cell therapy as "off-the-shelf" or "universal" because of the possibility for allogeneic cells to be prepared and stored for use in subjects of a variety of genotypes.

Any suitable methods of reducing expression and/or function the MHC class I complex are envisaged as within the scope of the instant disclosure, and include, inter alia, expression of interfering RNAs that knock down one or more RNAs encoding MHC class I components, or modifications of genes encoding MHC class I components. Methods of reducing expression and/or function of the MHC class I complex described herein are suitable for use with both allogeneic and autologous immune cells.

The major histocompatibility complex (MHC) is a locus on the vertebrate genome that encodes a set of polypeptides required for the adaptive immune system. Among these are MHC class I polypeptides that include HLA-A, HLA-B, and HLA-C and alleles thereof. MHC class I alleles are highly polymorphic and expressed in all nucleated cells. MHC class I polypeptides encoded by HLA-A, HLA-B, and HLA-C and alleles thereof form heterodimers with β2 microglobulin (B2M) and present in complex with antigens on the surface of cells. As referred to herein, an MHC class I gene or polypeptide may refer to any polypeptide found in the MHC or the corresponding gene encoding said polypeptide. In some embodiments, the immune cells of the disclosure are inactivated by an inhibitor ligand comprising an MHC class I polypeptide, e.g. HLA-A, HLA-B, and HLA-C and alleles thereof. HLA-A alleles can be, for example and without limitation, HLA-A*02, HLA-A*02:01, HLA-A*02:01:01, HLA-A*02:01:01:01, and/or any gene that encodes protein identical or similar to HLA-A*02 protein. Thus, to prevent autocrine signaling/binding as described herein, it is desirable to eliminate or reduce expression of polypeptides encoded by HLA-A, HLA-B, and HLA-C and alleles thereof in the immune cells.

Immune Cells with Reduced MHC Class I Polypeptide Expression

In some embodiments, the immune cells described herein are modified to inactivate, or reduce or eliminate expression or function of an endogenous gene encoding an allele of an endogenous MHC class I polypeptide. In some embodiments, the gene encoding the MHC class I polypeptide is HLA-A, HLA-B, and/or HLA-C. HLA-A, HLA-B and HLA-C are encoded by the HLA-A, HLA-B and HLA-C loci. Each of HLA-A, HLA-B and HLA-C includes many variant alleles, all of which are envisaged as within the scope of the instant disclosure. In some embodiments, the gene encoding the MHC class I polypeptide is HLA-A. In some embodiments, the gene encoding the MHC class I polypeptide is HLA-A*02. In some embodiments, the gene encoding the MHC class I polypeptide is HLA-A*02:01. In some embodiments, the gene encoding the MHC class I polypeptide is HLA-A*02:01:01. In some embodiments, the gene encoding the MHC class I polypeptide is HLA-A*02:01:01:01.

In some embodiments, the genetically engineered immune cells described herein are modified to reduce or eliminate expression of the B2M gene product. The beta-2 microglobulin (B2M) gene encodes a protein that associates with the major histocompatibility complex (MHC) class I, i.e. MHC-I complex. The MHC-I complex is required for presentation of antigens on the cell surface. The MHC-I complex is disrupted and non-functional when the B2M is deleted (Wang D et al. Stem Cells Transl Med. 4:1234-1245 (2015)). Furthermore, the B2M gene can be disrupted with high efficiency using gene editing techniques known in the art (Ren et al. Clin. Cancer Res. 23:2255-2266 (2017)). Reducing or eliminating B2M can reduce, or eliminate functional MHC I on the surface of the immune cell.

The disclosure provides gene editing systems for editing an endogenous target gene in an immune cell. The disclosure provides interfering RNAs specific to sequences of target genes. Gene editing systems such as CRISPR/Cas systems, TALENs and zinc fingers can be used to generate double strand breaks, which, through gene repair mechanisms such as homology directed repair or non-homologous end joining (NHEJ), can be used to introduce mutations. NHEJ after resection of the ends of the break, or improper end joining, can be used to introduce deletions. In some embodiments, the target gene comprises a gene encoding a subunit of the MHC-I complex.

Target gene sequences include, but are not limited to, promoters, enhancers, introns, exons, intron/exon junctions, transcription products (pre-mRNA, mRNA, and splice variants), and/or 3' and 5' untranslated regions (UTRs). Any gene element or combination of gene elements may be targeted for the purpose of genetic editing in the immune cells described herein. Modifications to the target genes can be accomplished using any method known in the art to edit the target gene that results in altered or disrupted expression or function the target gene or gene product.

In some embodiments, modifying the gene encoding the MHC class I polypeptide comprises deleting all or a portion of the gene. In some embodiments, modifying the gene encoding the MHC class I polypeptide comprises introducing a mutation in the gene. In some embodiments, the mutation comprises a deletion, insertion, substitution, or frameshift mutation. In some embodiments, modifying the gene comprises using a nucleic acid guided endonuclease.

Gene sequences for the target genes described herein are known in the art. The sequences can be found at public databases, such as NCBI GenBank or the NCBI nucleotide database. Sequences may be found using gene identifiers, for example, the HLA-A gene has NCBI Gene ID: 3105, the HLA-B gene has NCBI Gene ID: 3106, the HLA-C gene has NCBI Gene ID: 3107, and the B2M gene has NCBI Gene ID: 567 and NCBI Reference Sequence: NC_000015.10.

Gene sequences may also be found by searching public databases using keywords. For example, HLA-A alleles may be found in the NCBI nucleotide database by searching keywords, "HLA-A*02", "HLA-A*02:01", "HLA-A*02:01:01", or "HLA-A*02:01:01:01." These sequences can be used for targeting in various gene editing techniques known in the art. Table 8 provides non-limiting illustrative sequences of HLA-A allele and B2M gene sequences targeted for modification as described herein.

TABLE 8

Exemplary Target Gene Sequences

| | |
|---|---|
| B2M mRNA | (SEQ ID NO: 493) |
| B2M Gene (GenBank: 567) | (SEQ ID NO: 494) |
| HLA-A*02:01:01:01 sequence encoding mRNA | (SEQ ID NO: 495) |
| HLA-A*02 (GenBank: LK021978.1) | (SEQ ID NO: 496) |

*indicate protein positions with the indicated amino acids and codons
MAF: minor allele frequency The person of ordinary skill in the art will appreciate that T can be substituted for U to convert an RNA sequence to a DNA sequence and vice versa, and both are envisaged as target gene sequences of the disclosure.

In some embodiments, a target gene is edited in the immune cells described herein using a nucleic acid guided endonuclease. Exemplary nucleic acid guided endonucleases include Class II endonucleases, such as CRISPR/Cas9.

"CRISPR" or "CRISPR gene editing" as used herein refers to a set of clustered regularly interspaced short palindromic repeats, or a system comprising such a set of repeats. "Cas", as used herein, refers to a CRISPR-associated protein. A "CRISPR/Cas" system refers to a system derived from CRISPR and Cas which can be used to silence, knock out, or mutate a target gene. This system is a type of prokaryotic immune system that confers resistance to foreign genetic elements such as plasmids and phages and provides a form of acquired immunity. The CRISPR/Cas system has been modified for use in gene editing. This is accomplished by introducing into the eukaryotic cell a one or more specifically designed guide nucleic acids (gNAs), typically guide RNAs (gRNAs), and an appropriate Cas endonuclease which forms a ribonucleoprotein complex with the gNA. The gNA guides the gNA-endonuclease protein complex to a target genomic location, and the endonuclease introduces strand breakage at the target genomic location. This strand breakage can be repaired by cellular mechanisms such non-homologous end joining (leading to deletions) or homologous repair (which can generate insertions), thereby introducing genetic modifications into the host cell genome.

CRISPR/Cas systems are classified by class and by type. Class 2 systems currently represent a single interference protein that is categorized into three distinct types (types II, V and VI). Any class 2 CRISPR/Cas system suitable for gene editing, for example a type II, a type V or a type VI system, is envisaged as within the scope of the instant disclosure. Exemplary Class 2 type II CRISPR systems include Cas9, Csn2 and Cas4. Exemplary Class 2, type V CRISPR systems include, Cas12, Cas12a (Cpf1), Cas12b (C2c1), Cas12c (C2c3), Cas12d (CasY), Cas12e (CasX), Cas12f, Cas12g, Cas12h, Cas12i and Cas12k (C2c5). Exemplary Class 2 Type VI systems include Cas13, Cas13a (C2c2) Cas13b, Cas13c and Cas13d.

The CRISPR sequence, sometimes called a CRISPR locus, comprises alternating repeats and spacers. In a naturally-occurring CRISPR, the spacers usually comprise sequences foreign to the bacterium such as a plasmid or phage sequence. As described herein, spacer sequences may also be referred to as "targeting sequences." In CRISPR/Cas systems for a genetic engineering, the spacers are derived from the target gene sequence (the gNA).

An exemplary Class 2 type II CRISPR system relies on the protein Cas9, which is a nuclease with two active cutting sites, one for each strand of the double helix. Combining Cas9 and modified CRISPR locus RNA can be used in a system for gene editing. Pennisi (2013) Science 341: 833-836. In some embodiments, the Cas protein used to modify the immune cells is Cas9.

The CRISPR/Cas system can thus be used to edit a target gene, such as a gene targeted for editing in the immune cells described herein, by adding or deleting a base pair, or introducing a premature stop which thus decreases expression of the target. The CRISPR/Cas system can alternatively be used like RNA interference, turning off a target gene in a reversible fashion. In a mammalian cell, for example, the RNA can guide the Cas protein to a target gene promoter, sterically blocking RNA polymerases.

A Cas protein may be derived from any bacterial or archaeal Cas protein. Any suitable CRISPR/Cas system is envisaged as within the scope of the instant disclosure. In other aspects, Cas protein comprises one or more of Cas1, Cas1B, Cas2, Cas3, Cas4, Cas5, Cas6, Cas7, Cas8, Cas9, Cas10, Cas12a (Cpf1), Cas13, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, CasX, CasY, homologs thereof, or modified versions thereof. In some embodiments, the Cas protein is a Cas9 protein, a Cpf1 protein, a C2c1 protein, a C2c2 protein, a C2c3 protein, Cas3, Cas3-HD, Cas 5, Cas7, Cas8, Cas10, or combinations or complexes of these. In some embodiments, the Cas protein is a Cas9 protein.

Artificial CRISPR/Cas systems can be generated which inhibit a target gene, using technology known in the art, e.g., that described in U.S. Publication No. 20140068797, and Cong (2013) Science 339: 819-823. Other artificial CRISPR/Cas systems that are known in the art may also be generated which inhibit a target gene, e.g., that described in Tsai (2014) Nature Biotechnol., 32:6 569-576, U.S. Pat. Nos. 8,871,445; 8,865,406; 8,795,965; 8,771,945; and 8,697,359. Methods of designing suitable gNAs for a particular Cas protein will be known by persons of ordinary skill in the art.

The present disclosure provides gene-targeting guide nucleic acids (gNAs) that can direct the activities of an associated polypeptide (e.g., nucleic acid guided endonuclease) to a specific target gene sequence within a target nucleic acid genome. The genome-targeting nucleic acid can be an RNA. A genome-targeting RNA is referred to as a "guide RNA" or "gRNA" herein. A guide RNA can comprise at least a targeting sequence that hybridizes to a target nucleic acid sequence of interest, and a CRISPR repeat sequence. In some Type II systems, the gRNA also comprises a second RNA called the tracrRNA sequence, also referred to herein as a "scaffold" sequence. In the Type II guide RNA (gRNA), the CRISPR repeat sequence and scaffold sequence hybridize to each other to form a duplex. In the Type V guide RNA (gRNA), the crRNA forms a duplex. In both systems, the duplex can bind a site-directed polypeptide, such that the guide RNA and site-directed polypeptide form a complex. The gene-targeting nucleic acid can provide target specificity to the complex by virtue of its association with the site-directed polypeptide. The gene-targeting nucleic acid thus can direct the activity of the site-directed polypeptide.

In some embodiments, the disclosure provides a guide RNA comprising a targeting sequence and a guide RNA scaffold sequence, wherein the targeting sequence is complementary to the sequence of a target gene.

Exemplary guide RNAs include targeting sequences of about 15-20 bases. As is understood by the person of ordinary skill in the art, each gRNA can be designed to include a targeting sequence complementary to its genomic target sequence. For example, each of the targeting sequences, e.g., the RNA version of the DNA sequences presented in Table 9, minus the three 3' nucleotides which represent that PAM site, can be put into a single RNA chimera or a crRNA.

The gene targeting nucleic acid can be a double-molecule guide RNA. The gene targeting nucleic acid can be a single-molecule guide RNA. The gene targeting nucleic acid can be any known configuration of guide RNA known in the art, such as, for example, including paired gRNA, or multiple gRNAs used in a single step. Although it is clear from genomic sequences where the coding sequences and splice junctions are, other features required for gene expression may be idiosyncratic and unclear.

A double-molecule guide RNA can comprise two strands of RNA. The first strand comprises a sequence in the 5' to 3' direction, an optional spacer extension sequence, a targeting sequence and a minimum CRISPR repeat sequence. The second strand can comprise a minimum tracrRNA sequence (complementary to the minimum CRISPR repeat sequence), a 3' tracrRNA sequence and an optional tracrRNA extension sequence.

A single-molecule guide RNA (sgRNA) in a Type II system can comprise, in the 5' to 3' direction, an optional spacer extension sequence, a targeting sequence, a minimum CRISPR repeat sequence, a single-molecule guide linker, a minimum tracrRNA sequence, a 3' tracrRNA sequence and an optional tracrRNA extension sequence. The optional tracrRNA extension can comprise elements that contribute additional functionality (e.g., stability) to the guide RNA. The single-molecule guide linker can link the minimum CRISPR repeat and the minimum tracrRNA sequence to form a hairpin structure. The optional tracrRNA extension can comprise one or more hairpins.

In some embodiments, guide RNA or single-molecule guide RNA (sgRNA) can comprise a targeting sequence and a scaffold sequence. In some embodiments, the scaffold sequence is a Cas9 gRNA sequence. In some embodiments, the scaffold sequence is encoded by a DNA sequence that comprises a sequence that shares at least 90%, at least 95%, at least 96%, at least 97%, at least 98%, or at least 99% identity to GTTTTAGAGCTAGAAATAGCAAGT-TAAAATAAGGCT AGTCCGTTATCAACTT-GAAAAAGTGGCACCGAGTCGGTGCTTTTTTT (SEQ ID NO: 497). In some embodiments, the scaffold sequence is encoded by a DNA sequence that comprises GTTT-TAGAGCTAGAAATAGCAAGT-
TAAAATAAGGCTAGTCCGTTATCAACTT GAAAAAGTGGCACCGAGTCGGTGCTTTTTTT (SEQ ID NO: 497).

In some embodiments, for example those embodiments where the CRISPR/Cas system is a Cas9 system, the sgRNA can comprise a 20 nucleotide targeting sequence at the 5' end of the sgRNA sequence. The sgRNA can comprise a less than a 20 nucleotide targeting sequence at the 5' end of the sgRNA sequence. The sgRNA can comprise a more than 20 nucleotide targeting sequence at the 5' end of the sgRNA sequence. The sgRNA can comprise a variable length targeting sequence with 17-30 nucleotides at the 5' end of the sgRNA sequence.

Suitable scaffold sequences, and arrangement of scaffold targeting sequences, will depend on choice of endonuclease, and will be known to persons of skill in the art.

A single-molecule guide RNA (sgRNA) in a Type II system, e.g. Cas9, can comprise, in the 5' to 3' direction, a minimum CRISPR repeat sequence and a targeting sequence.

By way of illustration, guide RNAs used in the CRISPR/Cas9 or CRISPR/Cpf1 system, or other smaller RNAs can be readily synthesized by chemical means, as illustrated below and described in the art. While chemical synthetic procedures are continually expanding, purifications of such RNAs by procedures such as high performance liquid chromatography (HPLC, which avoids the use of gels such as PAGE) tends to become more challenging as polynucleotide lengths increase significantly beyond a hundred or so nucleotides. One approach used for generating RNAs of greater length is to produce two or more molecules that are ligated together. Much longer RNAs, such as those encoding a Cas9 or Cpf1 endonuclease, are more readily generated enzymatically. Various types of RNA modifications can be introduced during or after chemical synthesis and/or enzymatic generation of RNAs, e.g., modifications that enhance stability, reduce the likelihood or degree of innate immune response, and/or enhance other attributes, as described in the art.

The targeting sequence of a gRNA hybridizes to a sequence in a target nucleic acid of interest. The targeting sequence of a genome-targeting nucleic acid can interact with a target nucleic acid in a sequence-specific manner via hybridization (i.e., base pairing). The nucleotide sequence of the targeting sequence can vary depending on the sequence of the target nucleic acid of interest.

In a Cas9 system described herein, the targeting sequence can be designed to hybridize to a target nucleic acid that is located 5' of the reverse complement of a PAM of the Cas9 enzyme used in the system. The targeting sequence may perfectly match the target sequence or may have mismatches. Each CRISPR/Cas system protein may have a particular PAM sequence, in a particular orientation and position, that it recognizes in a target DNA. For example, S. pyogenes Cas9 recognizes in a target nucleic acid a PAM that comprises the sequence 5'-NRG-3', where R comprises either A or G, where N is any nucleotide and N is immediately 3' of the target nucleic acid sequence targeted by the targeting sequence. Selection of appropriate PAM sequences will be apparent to the person of ordinary skill in the art.

The target sequence is complementary to, and hybridizes with, the targeting sequence of the gRNA. The target nucleic acid sequence can comprise 20 nucleotides. The target nucleic acid can comprise less than 20 nucleotides. The target nucleic acid can comprise more than 20 nucleotides. The target nucleic acid can comprise at least: 5, 10, 15, 16, 17, 18, 19, 20, 21, 22, 23, 24, 25, 30 or more nucleotides. In some embodiments, for example those embodiments where the CRISPR/Cas system is a Cas9 system, the target nucleic acid sequence can comprise 20 nucleotides immediately 5' of the first nucleotide of the reverse complement of the PAM sequence. This target nucleic acid sequence is often referred to as the PAM strand or a target strand, and the complementary nucleic acid sequence is often referred to the non-PAM strand or non-target strand. One of skill in the art would recognize that the targeting sequence hybridizes to the non-PAM strand of the target nucleic acid, see e.g., US20190185849A1.

In some examples, the percent complementarity between the targeting sequence and the target nucleic acid is at least about 30%, at least about 40%, at least about 50%, at least about 60%, at least about 65%, at least about 70%, at least about 75%, at least about 80%, at least about 85%, at least about 90%, at least about 95%, at least about 97%, at least about 98%, at least about 99%, or 100%. In some examples, the percent complementarity between the targeting sequence and the target nucleic acid is at most about 30%, at most about 40%, at most about 50%, at most about 60%, at most about 65%, at most about 70%, at most about 75%, at most about 80%, at most about 85%, at most about 90%, at most about 95%, at most about 97%, at most about 98%, at most about 99%, or 100%. In some examples, the percent complementarity between the targeting sequence and the target nucleic acid is 100% over the six contiguous 5'-most nucleotides of the target sequence of the complementary strand of the target nucleic acid. The percent complementarity between the targeting sequence and the target nucleic acid can be at least 60% over about 20 contiguous nucleotides. The length of the targeting sequence and the target nucleic acid can differ by 1 to 6 nucleotides, which may be thought of as a bulge or bulges.

The targeting sequence can be designed or chosen using computer programs known to persons of ordinary skill in the art. The computer program can use variables, such as predicted melting temperature, secondary structure formation, predicted annealing temperature, sequence identity, genomic context, chromatin accessibility, % GC, frequency of genomic occurrence (e.g., of sequences that are identical or are similar but vary in one or more spots as a result of mismatch, insertion or deletion), methylation status, presence of SNPs, and the like. Available computer programs can take as input NCBI gene IDs, official gene symbols, Ensembl Gene IDs, genomic coordinates, or DNA sequences, and create an output file containing sgRNAs targeting the appropriate genomic regions designated as input. The computer program may also provide a summary of statistics and scores indicating on- and off-target binding of the sgRNA for the target gene (Doench et al. Nat Biotechnol. 34:184-191 (2016)). The disclosure provides guide RNAs comprising a targeting sequence. In some embodiments, the guide RNA further comprises a guide RNA scaffold sequence. In some embodiments, the targeting sequence is complementary to the sequence of a target gene selected from the group consisting of HLA-A, HLA-B, HLA-C, B2M or an allele thereof. In some embodiments, the target gene is an HLA-A gene. In some embodiments, the target gene is an HLA-B gene. In some embodiments, the target gene is an HLA-C gene. In some embodiments the target gene is HLA-A, HLA-B, HLA-C, or a combination thereof. In some embodiments, targeting sequence comprises a sequence that shares about 90%, about 95%, about 96%, about 97%, about 98%, about 99% identity to or is identical to a sequence disclosed in Table 8.

In some embodiments, the gNAs specifically target the sequence of an endogenous HLA-A locus. In some embodiments, the gNAs that specifically target the sequence of an HLA-A locus comprise a sequence that shares about 90%, about 95%, about 96%, about 97%, about 98%, or about 99% identity to a sequence selected from the sequences disclosed in Table 9. In some embodiments, the gNAs that specifically target the sequence of an HLA-A locus comprise a sequence selected from the sequences disclosed in Table 9.

In some embodiments, the gNAs specifically target a sequence of HLA-A*02 alleles. For example, the gRNAs specifically target, and hybridize to, a sequence shared by all HLA-A*02 alleles, but that is not shared by HLA-A*02 and HLA-A*03 alleles. In some embodiments, the gNAs specifically target a sequence of HLA-A*02:01 alleles. In some embodiments, the gNAs specifically target a sequence of HLA-A*02:01:01 alleles. In some embodiments, the gNAs specifically target a sequence of HLA-A*02:01:01:01 alleles. In some embodiments, the gNAs specifically target a sequence of HLA-A*02:01:01:01 alleles.

In some embodiments, the gNAs specifically target a coding DNA sequence of HLA-A*02.

In some embodiments, the gNAs specifically target a coding DNA sequence that is shared by more than 1000 HLA-A*02 alleles. In some embodiments, the gNAs that specifically target a coding DNA sequence in greater than 1000 HLA-A*02 alleles comprise a sequence that shares about 90%, about 95%, about 96%, about 97%, about 98%, about 99% identity or is identical to a sequence selected from SEQ ID NOs: 400-465.

The sequences in Tables 9-12 are presented as DNA sequences. The skilled artisan will understand that thymine (T) can be replaced with uracil (U) in any DNA sequence including those set forth in Tables 9-12, to arrive at the corresponding RNA sequence.

TABLE 9

Illustrative sequences targeting HLA-A and HLA-A alleles

| SEQ ID NO | Guide Nucleic Acid Targeting Sequences |
|---|---|
| 498 | TGGACGACACGCAGTTCGTG |
| 499 | CAGATACCTGGAGAACGGGA |
| 500 | TCCCGTTCTCCAGGTATCTG |
| 501 | CCGCCGCGGTCCAAGAGCGC |
| 502 | CCTGCGCTCTTGGACCGCGG |
| 503 | GGACCTGCGCTCTTGGACCGC |
| 504 | AAGGAGACGCTGCAGCGCACGGG |
| 505 | GAAGGAGACGCTGCAGCGCACGG |
| 506 | GCGGGCGCCGTGGATAGAGCAGG |
| 507 | TGCTCTATCCACGCGCCCGCGG |
| 508 | CGATGAAGCGGGGCTCCCCGCGG |
| 509 | CGTGTCCCGGCCCGGCCGCGGGG |
| 510 | CGGCTCCATCCTCTGGCTCGCGG |
| 511 | GATGTAATCCTTGCCGTCGTAGG |
| 512 | ACAGCGACGCCGCGAGCCAGAGG |
| 513 | GGATGGAGCCGCGGGCGCCGTGG |
| 514 | GGCGCCGTGGATAGAGCAGGAGG |
| 515 | GCGCCGTGGATAGAGCAGGAGG |
| 516 | CGGCTACTACAACCAGAGCGAGG |
| 517 | CTGGTTGTAGTAGCCGCGCAGGG |

TABLE 9-continued

Illustrative sequences targeting HLA-A and HLA-A alleles

| SEQ ID NO | Guide Nucleic Acid Targeting Sequences |
|---|---|
| 518 | TACTACAACCAGAGCGAGGCCGG |
| 519 | CTACCTGGAGGGCACGTGCGTGG |
| 520 | CACGCACGTGCCCTCCAGGTAGG |
| 521 | GCAGGGTCCCCAGGTCCACTCGG |
| 522 | GTGGACCTGGGGACCCTGCGCGG |
| 523 | TGGAGGGCACGTGCGTGGAGTGG |
| 524 | GTATGGCTGCGACGTGGGGTCGG |
| 525 | CTGAGCTGCCATGTCCGCCGCGG |
| 526 | GGATTACATCGCCCTGAAAGAGG |
| 527 | CAAGTGGGAGGCGGCCCATGTGG |
| 528 | GTGGGAGGCGGCCCATGTGGCGG |
| 529 | CAGTTGAGAGCCTACCTGGAGGG |
| 530 | GCAGTTGAGAGCCTACCTGGAGG |
| 531 | TACCACCAGTACGCCTACGACGG |
| 532 | TGCCGTCGTAGGCGTACTGGTGG |
| 533 | CCAGTACGCCTACGACGGCAAGG |
| 534 | GGATGTGAAGAAATACCTCATGG |
| 535 | ATTTCTTCACATCCGTGTCCCGG |
| 536 | AGGCGTACTGGTGGTACCCGCGG |
| 537 | CGTACTGGTGGTACCCGCGGAGG |
| 538 | GAGGATGTATGGCTGCGACGTGG |
| 539 | GGATGTATGGCTGCGACGTGGGG |
| 540 | CTCAGACCACCAAGCACAAGTGG |
| 541 | TCAGACCACCAAGCACAAGTGGG |
| 542 | CACCAAGCACAAGTGGGAGGCGG |
| 543 | GACCACCAAGCACAAGTGGGAGG |
| 544 | GAGCCCCGCTTCATCGCAGTGGG |
| 545 | GTAGCCCACTGCGATGAAGCGGG |
| 546 | TAGCCCACTGCGATGAAGCGGGG |
| 547 | CGTAGCCCACTGCGATGAAGCGG |
| 548 | CTTCATCGCAGTGGGCTACGTGG |
| 549 | GGAGCCCCGCTTCATCGCAGTGG |
| 550 | CGGGGAGACACGGAAAGTGAAGG |
| 551 | AGTATTGGGACGGGGAGACACGG |
| 552 | AGGGTCCGGAGTATTGGGACGGG |
| 553 | GAGGGTCCGGAGTATTGGGACGG |
| 554 | GGACCCTCCTGCTCTATCCACGG |

TABLE 9-continued

Illustrative sequences targeting HLA-A and HLA-A alleles

| SEQ ID NO | Guide Nucleic Acid Targeting Sequences |
|---|---|
| 555 | GTGGATAGAGCAGGAGGGTCCGG |
| 556 | AGACTCACCGAGTGGACCTGGGG |
| 557 | CACTCGGTGAGTCTGTGAGTGGG |
| 558 | CAGACTCACCGAGTGGACCTGGG |
| 559 | CCACTCACAGACTCACCGAGTGG |
| 560 | CCACTCGGTGAGTCTGTGAGTGG |
| 561 | TCGGACTGGCGCTTCCTCCGCGG |
| 562 | GCAGCCATACATCCTCTGGACGG |
| 563 | TCTCAACTGCTCCGCCACATGGG |
| 564 | ACCCTCATGCTGCACATGGCAGG |
| 565 | ACCTGCCATGTGCAGCATGAGGG |
| 566 | CACCTGCCATGTGCAGCATGAGG |
| 567 | GGAGGACCAGACCCAGGACACGG |
| 568 | GGATGGGGAGGACCAGACCCAGG |
| 569 | GACCTGGCAGCGGGATGGGGAGG |
| 570 | AGATCACACTGACCTGGCAGCGG |
| 571 | GATCACACTGACCTGGCAGCGGG |
| 572 | AGGTCAGTGTGATCTCCGCAGGG |
| 573 | AAGCCCCTCACCCTGAGATGGGG |
| 574 | CTGCGGAGATCACACTGACCTGG |
| 575 | CAGCAATGATGCCCACGATGGGG |
| 576 | CCAGCAATGATGCCCACGATGGG |
| 577 | GCCAGCAATGATGCCCACGATGG |
| 578 | GGATGGAACCTTCCAGAAGTGGG |
| 579 | GGGATGGAACCTTCCAGAAGTGG |
| 580 | ATGCCCACGATGGGGATGGTGGG |
| 581 | CAGCCCACCATCCCCATCGTGGG |
| 582 | CCAGCCCACCATCCCCATCGTGG |
| 583 | GATGCCCACGATGGGGATGGTGG |
| 584 | CAGGGCCCAGCACCTCAGGGTGG |
| 585 | AATGATGCCCACGATGGGGATGG |
| 586 | GGCCCTGACCCAGACCTGGGCGG |
| 587 | GACCCAGGACACGGAGCTCGTGG |
| 588 | ACACGGAGCTCGTGGAGACCAGG |
| 589 | CGTGGAGACCAGGCCTGCAGGGG |
| 590 | TCGTGGAGACCAGGCCTGCAGGG |
| 591 | AGCTGTGATCACTGGAGCTGTGG |

TABLE 9-continued

Illustrative sequences targeting HLA-A and HLA-A alleles

| SEQ ID NO | Guide Nucleic Acid Targeting Sequences |
|---|---|
| 592 | AAAAGGAGGGAGCTACTCTCAGG |
| 593 | ATGTGGAGGAGGAAGAGCTCAGG |
| 594 | GTGTCTCTCACAGCTTGTAAAGG |
| 595 | GAGAGACACATCAGAGCCCTGGG |
| 596 | CTCCGCAGGGTAGAAGCTCAGGG |
| 597 | GGCCCTGAGCTTCTACCCTGCGG |
| 598 | GCTCAGGGCCCAGCACCTCAGGG |
| 599 | TATCTCTGCTCCTGTCCAGAAGG |
| 600 | AGTAGCAGGACGAGGGTTCGGGG |
| 601 | CCCCGAGAGTAGCAGGACGAGGG |
| 602 | CCCTCGTCCTGCTACTCTCGGGG |
| 603 | CCTCGTCCTGCTACTCTCGGGGG |
| 604 | CTGTGGTCGCTGCTGTGATGTGG |
| 605 | TCGCTGCTGTGATGTGGAGGAGG |
| 606 | TGGTCGCTGCTGTGATGTGGAGG |
| 607 | CACAGCCGCCCACTTCTGGAAGG |
| 608 | CCAGAAGTGGGCGGCTGTGGTGG |
| 609 | TGGAACCTTCCAGAAGTGGGCGG |
| 610 | TCACAGCTCCAAAGAGAACCAGG |
| 611 | CTGACCATGAAGCCACCCTGAGG |
| 612 | GCAAACCCTCATGCTGCACATGG |
| 613 | TGAAGCCACCCTGAGGTGCTGGG |
| 614 | GGTGAGTCATATGCGTTTTGGGG |
| 615 | GTGAGTCATATGCGTTTTGGGGG |
| 616 | CTTCATGGTCAGAGACAGCGTGG |
| 617 | TCTGGCCCTGACCCAGACCTGGG |

The sequences disclosed in Table 9 include the corresponding genomic sequences, inclusive of the PAM sequence. The skilled artisan will understand that the targeting sequence of the gRNA does not include three 3' terminal nucleotides of the sequences in Table 9, which represent the corresponding PAM site for the gRNA.

The disclosure provides gNAs comprising a targeting sequence specific to the B2M gene. In some embodiments, the gNAs specifically target the coding sequence (CDS) sequence of the B32M gene. In some embodiments, the gNA comprises a sequence that targets the B2M gene promoter sequence.

In some embodiments the gNA comprise a targeting sequence and a gNA scaffold sequence. In some embodiments, the targeting sequence comprises a sequence set forth in Table 10, or a sequence shares about 90%, about 95%, about 96%, about 97%, about 98%, about 99% identity thereto.

In some embodiments, the targeting sequence is complementary to a sequence of the B2M gene. In some embodiments, the B2M gene comprises a sequence that shares about 9000, about 950%, about 96%, about 970%, about 98%, about 9900 identity to the B32M sequence set forth in Table 8.

TABLE 10

Illustrative sequences targeting B2M

| SEQ ID NO | Sequence |
|---|---|
| 618 | CGCGAGCACAGCTAAGGCCA |
| 619 | GAGTAGCGCGAGCACAGCTA |
| 620 | AGGGTAGGAGAGACTCACGC |
| 621 | CTGAATCTTTGGAGTACCTG |
| 622 | TCACGTCATCCAGCAGAGAA |
| 623 | TCCTGAATTGCTATGTGTCT |
| 624 | AAGTCAACTTCAATGTCGGA |
| 625 | GTCTTTTCCCGATATTCCTC |
| 626 | TGGAGTACCTGAGGAATATC |
| 627 | CAGCCCAAGATAGTTAAGTG |
| 628 | ACAAAGTCACATGGTTCACA |
| 629 | ACTCTCTCTTTCTGGCCTGG |
| 630 | TGGGCTGTGACAAAGTCACA |
| 631 | GGCCGAGATGTCTCGCTCCG |
| 632 | CAGTAAGTCAACTTCAATGT |
| 633 | ACTCACGCTGGATAGCCTCC |
| 634 | CATACTCATCTTTTTCAGTG |
| 635 | CACAGCCCAAGATAGTTAAG |
| 636 | TTCAGACTTGTCTTTCAGCA |
| 637 | AGTCACATGGTTCACACGGC |
| 638 | ATACTCATCTTTTTCAGTGG |
| 639 | GGCATACTCATCTTTTTCAG |
| 640 | ACAGCCCAAGATAGTTAAGT |
| 641 | GCTACTCTCTCTTTCTGGCC |
| 642 | TGGAGAGAATTGAAAAAG |
| 643 | ACTTGTCTTTCAGCAAGGAC |
| 644 | GAAGTTGACTTACTGAAGAA |
| 645 | GGCCACGGAGCGAGACATCT |
| 646 | GCATACTCATCTTTTTCAGT |
| 647 | CGTGAGTAAACCTGAATCTT |
| 648 | TTACCCCACTTAACTATCTT |
| 649 | TTGGAGTACCTGAGGAATAT |
| 650 | ACCCAGACACATAGCAATTC |

TABLE 10-continued

Illustrative sequences targeting B2M

| SEQ ID NO | Sequence |
|---|---|
| 651 | TTTGACTTTCCATTCTCTGC |
| 652 | TTCCTGAATTGCTATGTGTC |
| 653 | CTCAGGTACTCCAAAGATTC |
| 654 | CTTACCCCACTTAACTATCT |
| 655 | CTCGCGCTACTCTCTCTTTC |
| 656 | TCGATCTATGAAAAGACAG |
| 657 | GAGACATGTAAGCAGCATCA |
| 658 | ACATGTAAGCAGCATCATGG |
| 659 | GAAGTCCTAGAATGAGCGCC |
| 660 | GAGCGCCGGTGTCCCAAGC |
| 661 | AGCGCCGGTGTCCCAAGCT |
| 662 | GCGCCCGGTGTCCCAAGCTG |
| 663 | CTGGGGCGCGCACCCCAGAT |
| 664 | GGGCGCGCACCCCAGATCGG |
| 665 | GGCGCGCACCCCAGATCGGA |
| 666 | CATCACGAGACTCTAAGAAA |
| 667 | TAAGAAAAGGAAACTGAAAA |
| 668 | AAGAAAAGGAAACTGAAAAC |
| 669 | GAAAGTCCCTCTCTCTAACC |
| 670 | CTAACCTGGCACTGCGTCGC |
| 671 | CTGGCACTGCGTCGCTGGCT |
| 672 | TGCGTCGCTGGCTTGGAGAC |
| 673 | GCTGGCTTGGAGACAGGTGA |
| 674 | GAGACAGGTGACGGTCCCTG |
| 675 | AGACAGGTGACGGTCCCTGC |
| 676 | CCTGCGGGCCTTGTCCTGAT |
| 677 | CGGGCCTTGTCCTGATTGGC |
| 678 | GGGCCTTGTCCTGATTGGCT |
| 679 | GGGCACGCGTTTAATATAAG |
| 680 | CACGCGTTTAATATAAGTGG |
| 681 | TATAAGTGGAGGCGTCGCGC |
| 682 | AAGTGGAGGCGTCGCGCTGG |
| 683 | AGTGGAGGCGTCGCGCTGGC |
| 684 | TTCCTGAAGCTGACAGCATT |
| 685 | TCCTGAAGCTGACAGCATTC |
| 686 | GCCCGAATGCTGTCAGCTTC |
| 687 | AAACGCGTGCCCAGCCAATC |
| 688 | GTGCCCAGCCAATCAGGACA |
| 689 | CCAATCAGGACAAGGCCCGC |
| 690 | CAATCAGGACAAGGCCCGCA |
| 691 | CAAGCCAGCGACGCAGTGCC |
| 692 | CGCAGTGCCAGGTTAGAGAG |
| 693 | GCAGTGCCAGGTTAGAGAGA |
| 694 | GAGTCTCGTGATGTTTAAGA |
| 695 | TAAGAAGGCATGCACTAGAC |
| 696 | AAGAAGGCATGCACTAGACT |
| 697 | TGAGTTTGCTGTCTGTACAT |
| 698 | TACATCGGCGCCCTCCGATC |
| 699 | ACATCGGCGCCCTCCGATCT |
| 700 | CATCGGCGCCCTCCGATCTG |
| 701 | CTGGGGTGCGCGCCCCAGCT |
| 702 | TGGGGTGCGCGCCCCAGCTT |
| 703 | CGCGCCCCAGCTTGGGACAC |
| 704 | GCGCCCCAGCTTGGGACACC |
| 705 | CAAGTCACTTAGCATCTCTG |
| 706 | ACAGAAGTTCTCCTTCTGCT |
| 707 | ATTCAAAGATCTTAATCTTC |
| 708 | TTCAAAGATCTTAATCTTCT |
| 709 | TTTTCTCGAATGAAAAATGC |
| 710 | TGCAGGTCCGAGCAGTTAAC |
| 711 | GGTCCGAGCAGTTAACTGGC |
| 712 | GTCCGAGCAGTTAACTGGCT |
| 713 | TCCGAGCAGTTAACTGGCTG |
| 714 | AGCAAGTCACTTAGCATCTC |
| 715 | GCAAGTCACTTAGCATCTCT |
| 716 | TGGGGCCAGTCTGCAAAGCG |
| 717 | GGGGCCAGTCTGCAAAGCGA |
| 718 | GGGCCAGTCTGCAAAGCGAG |
| 719 | GGCCAGTCTGCAAAGCGAGG |
| 720 | GGACACCGGGCGCTCATTCT |
| 721 | GGCGCTCATTCTAGGACTTC |
| 722 | CTCATTCTAGGACTTCAGGC |
| 723 | ATTCTAGGACTTCAGGCTGG |
| 724 | TTCAGGCTGGAGGCACATTA |

TABLE 10-continued

Illustrative sequences targeting B2M

| SEQ ID NO | Sequence |
|---|---|
| 725 | TGCCCCCTCGCTTTGCAGAC |
| 726 | GATGCTAAGTGACTTGCTAA |
| 727 | GCCCCAGCCAGTTAACTGCT |
| 728 | GCATTTTTCATTCGAGAAAA |
| 729 | TTTGAATGCTACCTAGCAGA |
| 730 | TTCTGTTTATAACTACAGCT |
| 731 | TCTGTTTATAACTACAGCTT |

In some embodiments, the immune cells described herein are edited using TALEN gene editing.

"TALEN" or "TALEN gene editing" refers to a transcription activator-like effector nuclease, which is an artificial nuclease used to edit a target gene.

TALENs are produced artificially by fusing a TAL effector DNA binding domain to a DNA cleavage domain. Transcription activator-like effectors (TALEs) derived from *Xanthomonas* bacteria can be engineered to bind any desired DNA sequence, including a portion of target genes such as TCR subunits, MHC class I complex components, or CD52. By combining an engineered TALE with a DNA cleavage domain, a restriction enzyme can be produced which is specific to any desired DNA sequence, including a target gene sequence. These can then be introduced into a cell, wherein they can be used for genome editing.

To produce a TALEN, a TALE protein is fused to a nuclease (N), which is a wild-type or mutated FokI endonuclease. Several mutations to FokI have been made for its use in TALENs; these, for example, improve cleavage specificity or activity.

The FokI domain functions as a dimer, requiring two constructs with unique DNA binding domains for sites in the target genome with proper orientation and spacing. Both the number of amino acid residues between the TALE DNA binding domain and the FokI cleavage domain and the number of bases between the two individual TALEN binding sites appear to be important parameters for achieving high levels of activity.

TALENs specific to sequences in a target gene can be constructed using any method known in the art, including various schemes using modular components.

In some embodiments, a target gene is edited in the immune cells described herein using ZFN gene editing.

"ZFN" or "Zinc Finger Nuclease" or "ZFN gene editing" refer to a zinc finger nuclease, an artificial nuclease which can be used to edit a target gene.

Like a TALEN, a ZFN comprises a FokI nuclease domain (or derivative thereof) fused to a DNA-binding domain. In the case of a ZFN, the DNA-binding domain comprises one or more zinc fingers.

A zinc finger is a small protein structural motif stabilized by one or more zinc ions. A zinc finger can comprise, for example, Cys2His2, and can recognize an approximately 3-bp sequence. Various zinc fingers of known specificity can be combined to produce multi-finger polypeptides which recognize about 6, 9, 12, 15 or 18-bp sequences. Various selection and modular assembly techniques are available to generate zinc fingers (and combinations thereof) recognizing specific sequences, including phage display, yeast one-hybrid systems, bacterial one-hybrid and two-hybrid systems, and mammalian cells.

Like a TALEN, a ZFN must dimerize to cleave DNA. Thus, a pair of ZFNs are required to target non-palindromic DNA sites. The two individual ZFNs must bind opposite strands of the DNA with their nucleases properly spaced apart.

Also like a TALEN, a ZFN can create a double-stranded break in the DNA, which can create a frame-shift mutation if improperly repaired, leading to a decrease in the expression and amount of a target gene or gene product in a cell. ZFNs can also be used with homologous recombination to mutate in a target gene.

ZFNs specific to sequences in a target gene can be constructed using any method known in the art.

In some embodiments, the expression and of function of one or more MCH-I components are reduced using RNA interference. "RNAi" or "RNA interference" refers to the process of sequence-specific post-transcriptional gene silencing, mediated by double-stranded RNA (dsRNA). Duplex RNAs such as siRNA (small interfering RNA), miRNA (micro RNA), shRNA (short hairpin RNA), ddRNA (DNA-directed RNA), piRNA (Piwi-interacting RNA), or rasiRNA (repeat associated siRNA) and modified forms thereof are all capable of mediating RNA interference. These dsRNA molecules may be commercially available or may be designed and prepared based on known sequence information. The anti-sense strand of these molecules can include RNA, DNA, PNA, or a combination thereof. DNA/RNA chimeric polynucleotides include, but are not limited to, a double-strand polynucleotide composed of DNA and RNA that inhibits the expression of a target gene. dsRNA molecules can also include one or more modified nucleotides, as described herein, which can be incorporated on either or both strands.

In RNAi gene silencing or knockdown, dsRNA comprising a first (anti-sense) strand that is complementary to a portion of a target gene and a second (sense) strand that is fully or partially complementary to the first anti-sense strand is introduced into an organism. After introduction into the organism, the target gene-specific dsRNA is processed into relatively small fragments (siRNAs) and can subsequently become distributed throughout the organism, decrease messenger RNA of target gene, leading to a phenotype that may come to closely resemble the phenotype arising from a complete or partial deletion of the target gene.

Certain dsRNAs in cells can undergo the action of Dicer enzyme, a ribonuclease III enzyme. Dicer can process the dsRNA into shorter pieces of dsRNA, i.e. siRNAs. RNAi also involves an endonuclease complex known as the RNA induced silencing complex (RISC). Following cleavage by Dicer, siRNAs enter the RISC complex and direct cleavage of a single stranded RNA target having a sequence complementary to the anti-sense strand of the siRNA duplex. The other strand of the siRNA is the passenger strand. Cleavage of the target RNA takes place in the middle of the region complementary to the anti-sense strand of the siRNA duplex. siRNAs can thus down regulate or knock down gene expression by mediating RNA interference in a sequence-specific manner.

As used herein with respect to RNA interference, "target gene" or "target sequence" refers to a gene or gene sequence whose corresponding RNA is targeted for degradation through the RNAi pathway using dsRNAs or siRNAs as described herein. Exemplary target gene sequences are shown in Table 8. To target a gene, for example using an siRNA, the siRNA comprises an anti-sense region complementary to, or substantially complementary to, at least a portion of the target gene or sequence, and sense strand complementary to the anti-sense strand. Once introduced into a cell, the siRNA directs the RISC complex to cleave an RNA comprising a target sequence, thereby degrading the RNA. The disclosure provides interfering RNAs. The double stranded RNA molecule of the disclosure may be in the form of any type of RNA interference molecule known in the art. In some embodiments, the double stranded RNA molecule is a small interfering RNA (siRNA). In other embodiments, the double stranded RNA molecule is a short hairpin RNA (shRNA) molecule. In other embodiments, the double stranded RNA molecule is a Dicer substrate that is processed in a cell to produce an siRNA. In other embodiments the double stranded RNA molecule is part of a microRNA precursor molecule.

In some embodiments, the shRNA is a length to be suitable as a Dicer substrate, which can be processed to produce a RISC active siRNA molecule. See, e.g., Rossi et al., US2005/0244858.

A Dicer substrate double stranded RNA (e.g. a shRNA) can be of a length sufficient that it is processed by Dicer to produce an active siRNA, and may further include one or more of the following properties: (i) the Dicer substrate shRNA can be asymmetric, for example, having a 3' overhang on the anti-sense strand, (ii) the Dicer substrate shRNA can have a modified 3' end on the sense strand to direct orientation of Dicer binding and processing of the dsRNA to an active siRNA, for example the incorporation of one or more DNA nucleotides, and (iii) the first and second strands of the Dicer substrate ds RNA can be from 21-30 bp in length.

In some embodiments, the interfering RNAs comprise a sequence complementary to a sequence of a B2M mRNA. In some embodiments, the interfering RNA is capable of inducing RNAi-mediated degradation of the B2M mRNA. In some embodiments, the B2M mRNA sequence comprises a coding sequence. In some embodiments, the B2M mRNA sequence comprises an untranslated region.

In some embodiments, the interfering RNAs comprise a sequence complementary to a sequence of an HLA-A*02 mRNA. In some embodiments, the interfering RNA is capable of inducing RNAi-mediated degradation of the HLA-A*02 mRNA. In some embodiments, the HLA-A*02 mRNA sequence comprises a coding sequence. In some embodiments, the HLA-A*02 mRNA sequence comprises an untranslated region.

In some embodiments, the interfering RNA is a short hairpin RNA (shRNA). In some embodiments, the shRNA comprises a first sequence, having from 5' to 3' end a sequence complementary to the B2M mRNA; and a second sequence, having from 5' to 3' end a sequence complementary to the first sequence, wherein the first sequence and second sequence form the shRNA.

In some embodiments, the first sequence is 18, 19, 20, 21, or 22 nucleotides. In some embodiments, the first sequence is complementary to a sequence selected from the sequences set forth in Tables 11 and 12. In some embodiments, the first sequence has GC content greater than or equal to 25% and less than 60%. In some embodiments, the first sequence is complementary to a sequence selected from the sequences set forth in Tables 11 and 12. In some embodiments, the first sequence does not comprise four nucleotides of the same base or a run of seven C or G nucleotide bases. In some embodiments, the first sequence is 21 nucleotides.

Illustrative target B32M sequences complementary to the first sequence are shown in Table 11.

In some cases, the first sequence may have 100% identity, i.e. complete identity, homology, complementarity to the target nucleic acid sequence. In other cases, there may be one or more mismatches between the first sequence and the target nucleic acid sequence. For example, there may be 1, 2, 3, 4, 5, 6, or 7 mismatches between the sense region and the target nucleic acid sequence.

The sequences set forth in Table 11 are presented as DNA sequences. In all sequences set forth in Table 11, thymine (T) may be replaced by uracil (U) to arrive at the sequence of the target mRNA sequence.

TABLE 11

Illustrative target B2M sequences complementary to first sequence

| SEQ ID NO | Sequence |
|---|---|
| 732 | AGAGAATGGAAAGTCAAATTT |
| 733 | ATGGACATGATCTTCTTTATA |
| 734 | TGGACATGATCTTCTTTATAA |
| 735 | GGACATGATCTTCTTTATAAT |
| 736 | TGACAGGATTATTGGAAATTT |
| 737 | TTGTGGTTAATCTGGTTTATT |
| 738 | TGTGGTTAATCTGGTTTATTT |
| 739 | GCAGAGAATGGAAAGTCAAAT |
| 740 | CAGAGAATGGAAAGTCAAATT |
| 741 | GAGAATGGAAAGTCAAATTTC |
| 742 | GTCACAGCCCAAGATAGTTAA |
| 743 | TGCTTATACACTTACACTTTA |
| 744 | GCTTATACACTTACACTTTAT |
| 745 | CTTATACACTTACACTTTATG |
| 746 | ACATGGACATGATCTTCTTTA |
| 747 | CATGGACATGATCTTCTTTAT |
| 748 | ATCAACATCTTGGTCAGATTT |
| 749 | CTTGCACTCAAAGCTTGTTAA |
| 750 | AGTTAAGCGTGCATAAGTTAA |
| 751 | GCATAAGTTAACTTCCAATTT |
| 752 | TACATACTCTGCTTAGAATTT |
| 753 | ACATACTCTGCTTAGAATTTG |
| 754 | TTGACAGGATTATTGGAAATT |
| 755 | GACAGGATTATTGGAAATTTG |
| 756 | TAAGGCATGGTTGTGGTTAAT |
| 757 | GTTGTGGTTAATCTGGTTTAT |
| 758 | GTTCCACAAGTTAAATAAATC |
| 759 | TCCAGCGTACTCCAAAGATTC |

TABLE 11-continued

Illustrative target B2M sequences complementary to first sequence

| SEQ ID NO | Sequence |
|---|---|
| 760 | TACTCCAAAGATTCAGGTTTA |
| 761 | ACTCCAAAGATTCAGGTTTAC |
| 762 | CACGTCATCCAGCAGAGAATG |
| 763 | GGTTTCATCCATCCGACATTG |
| 764 | CCGACATTGAAGTTGACTTAC |
| 765 | TGAAGAATGGAGAGAGAATTG |
| 766 | GAGCATTCAGACTTGTCTTTC |
| 767 | TTCAGCAAGGACTGGTCTTTC |
| 768 | GCAAGGACTGGTCTTTCTATC |
| 769 | CGTGTGAACCATGTGACTTTG |
| 770 | CTTTGTCACAGCCCAAGATAG |
| 771 | TCACAGCCCAAGATAGTTAAG |
| 772 | AGTGGGATCGAGACATGTAAG |
| 773 | AGGTTTGAAGATGCCGCATTT |
| 774 | GGTTTGAAGATGCCGCATTTG |
| 775 | TTGATATGCTTATACACTTAC |
| 776 | TGAGTGCTGTCTCCATGTTTG |
| 777 | TGTCTCCATGTTTGATGTATC |
| 778 | TCAACATCTTGGTCAGATTTG |
| 779 | TCAGATTTGAACTCTTCAATC |
| 780 | TTCAATCTCTTGCACTCAAAG |
| 781 | TTGCACTCAAAGCTTGTTAAG |
| 782 | ACTCAAAGCTTGTTAAGATAG |
| 783 | AGATAGTTAAGCGTGCATAAG |
| 784 | TGCATAAGTTAACTTCCAATT |
| 785 | GTTAACTTCCAATTTACATAC |
| 786 | ATTGACAGGATTATTGGAAAT |
| 787 | GTAAGGCATGGTTGTGGTTAA |
| 788 | GGTTGTGGTTAATCTGGTTTA |
| 789 | TTCCTGAAGCTGACAGCATTC |
| 790 | GCTATCCAGCGTACTCCAAAG |
| 791 | CATCCAGCAGAGAATGGAAAG |
| 792 | CAAATTTCCTGAATTGCTATG |
| 793 | ATTGCTATGTGTCTGGGTTTC |
| 794 | GAAGATGCCGCATTTGGATTG |
| 795 | CAATTTACATACTCTGCTTAG |
| 796 | TATCCAGCGTACTCCAAAGAT |
| 797 | ATCCAGCGTACTCCAAAGATT |
| 798 | CTCCAAAGATTCAGGTTTACT |
| 799 | TGCTATGTGTCTGGGTTTCAT |
| 800 | TTTCATCCATCCGACATTGAA |
| 801 | GAAGTTGACTTACTGAAGAAT |
| 802 | GAAGAATGGAGAGAGAATTGA |
| 803 | AGAATGGAGAGAGAATTGAAA |
| 804 | CAGCAAGGACTGGTCTTTCTA |
| 805 | AGCAAGGACTGGTCTTTCTAT |
| 806 | ACTTTGTCACAGCCCAAGATA |
| 807 | TTGTCACAGCCCAAGATAGTT |
| 808 | TGTCACAGCCCAAGATAGTTA |
| 809 | CACAGCCCAAGATAGTTAAGT |
| 810 | GCAGCATCATGGAGGTTTGAA |
| 811 | CCGCATTTGGATTGGATGAAT |
| 812 | TTGAGTGCTGTCTCCATGTTT |
| 813 | AGTGCTGTCTCCATGTTTGAT |
| 814 | CTGTCTCCATGTTTGATGTAT |
| 815 | TCTAGGAGGGCTGGCAACTTA |
| 816 | CAACATCTTGGTCAGATTTGA |
| 817 | GTCAGATTTGAACTCTTCAAT |
| 818 | TCTTGCACTCAAAGCTTGTTA |
| 819 | TGCACTCAAAGCTTGTTAAGA |
| 820 | GCACTCAAAGCTTGTTAAGAT |
| 821 | CACTCAAAGCTTGTTAAGATA |
| 822 | TCAAAGCTTGTTAAGATAGTT |
| 823 | CAAAGCTTGTTAAGATAGTTA |
| 824 | GATAGTTAAGCGTGCATAAGT |
| 825 | ATAGTTAAGCGTGCATAAGTT |
| 826 | TAGTTAAGCGTGCATAAGTTA |
| 827 | TTAAGCGTGCATAAGTTAACT |
| 828 | TAAGCGTGCATAAGTTAACTT |
| 829 | ATTTACATACTCTGCTTAGAA |
| 830 | TTTACATACTCTGCTTAGAAT |
| 831 | ACAGGATTATTGGAAATTTGT |
| 832 | CAGGATTATTGGAAATTTGTT |
| 833 | AGGCATGGTTGTGGTTAATCT |

TABLE 11-continued

Illustrative target B2M sequences complementary to first sequence

| SEQ ID NO | Sequence |
|---|---|
| 834 | CAGCAGAGAATGGAAAGTCAA |
| 835 | TCCGACATTGAAGTTGACTTA |
| 836 | CTGGTCTTTCTATCTCTTGTA |
| 837 | CCGTGTGAACCATGTGACTTT |
| 838 | CCCAAGATAGTTAAGTGGGAT |
| 839 | GGTTGCTCCACAGGTAGCTCT |
| 840 | GCTCCACAGGTAGCTCTAGGA |
| 841 | GGGAGCAGAGAATTCTCTTAT |
| 842 | GGAGCAGAGAATTCTCTTATC |
| 843 | GAGCAGAGAATTCTCTTATCC |
| 844 | GAGAATTCTCTTATCCAACAT |
| 845 | GAATTCTCTTATCCAACATCA |
| 846 | AAGTGGAGCATTCAGACTTGT |
| 847 | AAGGACTGGTCTTTCTATCTC |
| 848 | AAGCTTGTTAAGATAGTTAAG |
| 849 | AAGCGTGCATAAGTTAACTTC |
| 850 | AAGATGCCGCATTTGGATTGG |
| 851 | AAGAATGGAGAGAGAATTGAA |
| 852 | AACATCAACATCTTGGTCAGA |
| 853 | AAGGCATGGTTGTGGTTAATC |
| 854 | AAGCAGCATCATGGAGGTTTG |
| 855 | AAGATGAGTATGCCTGCCGTG |
| 856 | AAGTTGACTTACTGAAGAATG |
| 857 | AAGATAGTTAAGCGTGCATAA |
| 858 | AACTTCCAATTTACATACTCT |
| 859 | AACATCTTGGTCAGATTTGAA |
| 860 | AACTCTTCAATCTCTTGCACT |
| 861 | AATTTCCTGAATTGCTATGTG |
| 862 | AATGGAAAGTCAAATTTCCTG |
| 863 | AACCATGTGACTTTGTCACAG |
| 864 | AATTGACAGGATTATTGGAAA |
| 865 | AATTCTCTTATCCAACATCAA |
| 866 | AAAGTGGAGCATTCAGACTTG |
| 867 | AAAGTCAAATTTCCTGAATTG |
| 868 | GTTGCTCCACAGGTAGCTCTA |
| 869 | AATTTACATACTCTGCTTAGA |

An exemplary sequence encoding a B2M shRNA comprises a sequence of GCACTCAAAGCTTGTTAAGATCGAAATCTTAACAAGCTTTGAGTGC (SEQ ID NO: 179), or a sequence having at least 9000, at least 9500, at least 970% or at least 990% identity thereto. A further exemplary sequence encoding a B2M shRNA comprises a sequence of GTTAACTTCCAATTTACATACCGAAGTATGTAAATTGGAAGTTAAC (SEQ ID NO: 180), or a sequence having at least 9000, at least 9500, at least 9700 or at least 9900 identity thereto.

In some embodiments, the interfering RNAs comprise a sequence complementary to a sequence of an HLA-A*02 mRNA. In some embodiments, the interfering RNA is capable of inducing RNAi-mediated degradation of the HLA-A*02 mRNA. In some embodiments, the HLA-A*02 mRNA sequence comprises a coding sequence. In some embodiments, the HLA-A*02 mRNA sequence comprises an untranslated region.

In some embodiments, the interfering RNA is a short hairpin RNA (shRNA). In some embodiments, the shRNA comprises a first sequence, having from 5' to 3' end a sequence complementary to the HLA-A*02 mRNA; and a second sequence, having from 5' to 3' end a sequence complementary to the first sequence, wherein the first sequence and second sequence form the shRNA Illustrative target HLA sequences complementary to the first sequence are shown in Table 12.

TABLE 12

Illustrative target HLA sequences complementary to first sequence

| SEQ ID NO | Sequence |
|---|---|
| 870 | CTTCTTCCTTCCCTATTAAAA |
| 871 | TCTCACTCCATGAGGTATTTC |
| 872 | CTCTCACTCCATGAGGTATTT |
| 873 | GAGGAGGAAGAGCTCAGATAG |
| 874 | GCTCTCACTCCATGAGGTATT |
| 875 | AGGATTACATCGCCCTGAAAG |
| 876 | ACACCGTCCAGAGGATGTATG |
| 877 | AGGGTCCTTCTTCCTGGATAC |
| 878 | CCTACGACGGCAAGGATTACA |
| 879 | TCACTCCATGAGGTATTTCTT |
| 880 | CTACGACGGCAAGGATTACAT |
| 881 | CTCACTCCATGAGGTATTTCT |
| 882 | GGAGGAAGAGCTCAGATAGAA |
| 883 | CACACCGTCCAGAGGATGTAT |
| 884 | CACGCTGTCTCTGACCATGAA |
| 885 | CTGGACAGGAGCAGAGATACA |
| 886 | TGGAGGAGGAAGAGCTCAGAT |
| 887 | GGCTCTCACTCCATGAGGTAT |
| 888 | CATCTCTGTCTCAACTTCATG |

TABLE 12-continued

Illustrative target HLA sequences complementary to first sequence

| SEQ ID NO | Sequence |
|---|---|
| 889 | TACGACGGCAAGGATTACATC |
| 890 | GGATTACATCGCCCTGAAAGA |
| 891 | GATTACATCGCCCTGAAAGAG |
| 892 | CTCAGACCACCAAGCACAAGT |
| 893 | TCACACCGTCCAGAGGATGTA |
| 894 | ACTCCATGAGGTATTTCTTCA |
| 895 | CACTCCATGAGGTATTTCTTC |
| 896 | CCATGAGGTATTTCTTCACAT |
| 897 | ACTTCTTCCTTCCCTATTAAA |
| 898 | GTGTCTCTCACAGCTTGTAAA |
| 899 | CTGTGTTCGTGTAGGCATAAT |
| 900 | TGTGTTCGTGTAGGCATAATG |
| 901 | TAACTTCTTCCTTCCCTATTA |
| 902 | TCTGGACAGGAGCAGAGATAC |
| 903 | TTGCTGGCCTGGTTCTCTTTG |
| 904 | TGTCTCTCACAGCTTGTAAAG |
| 905 | ACTTGAAGAACCCTGACTTTG |
| 906 | GAAGAACCCTGACTTTGTTTC |
| 907 | TCTGTGTTCGTGTAGGCATAA |
| 908 | CATGGTGCACTGAGCTGTAAC |
| 909 | GTAACTTCTTCCTTCCCTATT |
| 910 | CATGTGCAGCATGAGGGTTTG |
| 911 | TTGTTCCTGCCCTTCCCTTTG |
| 912 | ACCCAGTTCTCACTCCCATTG |
| 913 | GGGTTTCCAGAGAAGCCAATC |
| 914 | TTCTCCCTCTCCCAACCTATG |
| 915 | GTCTCTCACAGCTTGTAAAGT |
| 916 | TGTGTCTCTCACAGCTTGTAA |
| 917 | GAGGAAGAGCTCAGATAGAAA |
| 918 | TGAAGAACCCTGACTTTGTTT |
| 919 | TTGAAGAACCCTGACTTTGTT |
| 920 | GTGTTCGTGTAGGCATAATGT |
| 921 | TGGTGCACTGAGCTGTAACTT |
| 922 | CTCCCTCTCCCAACCTATGTA |
| 923 | AGGAGGAAGAGCTCAGATAGA |
| 924 | ACCTATGTAGGGTCCTTCTTC |
| 925 | GGGTCCTTCTTCCTGGATACT |
| 926 | GGTCCTTCTTCCTGGATACTC |
| 927 | GTCCTTCTTCCTGGATACTCA |
| 928 | AAGCCAATCAGTGTCGTCGCG |
| 929 | AAGAGGACCTGCGCTCTTGGA |
| 930 | AAGTGTGAGACAGCTGCCTTG |
| 931 | AAGGCACCTGCATGTGTCTGT |
| 932 | AATCATCTTTCCTGTTCCAGA |
| 933 | AAAGGCACCTGCATGTGTCTG |
| 934 | AAAGAGGACCTGCGCTCTTGG |
| 935 | AAACGCATATGACTCACCACG |
| 936 | GGAAGAGCTCAGATAGAAA |
| 937 | GGGAGACACGGAAAGTGAA |
| 938 | CACCTGCCATGTGCAGCATGA |
| 939 | GGAGATCACACTGACCTGGCA |
| 940 | GGATTACATCGCCCTGAAAG |
| 941 | GCAGGAGGGTCCGGAGTATT |
| 942 | GGACGGGGAGACACGGAAAG |
| 943 | GAAAGTGAAGGCCCACTCA |
| 944 | GATACCTGGAGAACGGGAAG |
| 945 | GCTGTGGTGGTGCCTTCTGG |
| 946 | GCTACTACAACCAGAGCGAG |
| 947 | GTGGCTCCGCAGATACCTG |
| 948 | GCCAATCAGTGTCGTCGCG |
| 949 | GAGGACCTGCGCTCTTGGA |
| 950 | GTGTGAGACAGCTGCCTTG |
| 951 | GGCACCTGCATGTGTCTGT |
| 952 | TCATCTTTCCTGTTCCAGA |
| 953 | AGGCACCTGCATGTGTCTG |
| 954 | AGAGGACCTGCGCTCTTGG |
| 955 | ACGCATATGACTCACCACG |

In some embodiments, the first sequence and second sequence are separated by a linker, sometimes referred to as a loop. In some embodiments, both the first sequence and the second sequence are encoded by one single-stranded RNA or DNA vector. In some embodiments, the loop is between the first and second sequences. In these embodiments, and the first sequence and the second sequence hybridize to form a duplex region. The first sequence and second sequence are joined by a linker sequence, forming a "hairpin" or "stem-loop" structure. The shRNA can have complementary first sequences and second sequences at opposing ends of a single stranded molecule, so that the molecule can form a duplex region with the complementary sequence portions, and the strands are linked at one end of the duplex region by a linker (i.e. loop sequence). The linker, or loop sequence, can be either a nucleotide or non-nucleotide linker. The linker can interact with the first sequence, and optionally, second sequence through covalent bonds or non-covalent interactions.

Any suitable nucleotide loop sequence is envisaged as within the scope of the disclosure. An shRNA of this disclosure may include a nucleotide, non-nucleotide, or mixed nucleotide/non-nucleotide linker that joins the first sequence of the shRNA to the second sequence of the shRNA. A nucleotide loop sequence can be >2 nucleotides in length, for example about 4, 5, 6, 7, 8, 9, 10, 11, 12, 13, 14, or 15 nucleotides in length. Illustrative loop sequences are disclosed in Table 14.

In some embodiments, the shRNA further comprises a 5' flank sequence and a 3' flank sequence. In some embodiments, wherein the 5' flank sequence is joined to the 5' end of the first sequence, and wherein the 3' flank sequence is joined to the 3' end of the second sequence.

Without wishing to be bound by theory, it is thought that flanking shRNA stem loop sequence with 5' and 3' sequences similar to those found in microRNAs can target the shRNA for processing by the endogenous microRNA processing machinery, increasing the effectiveness of shRNA processing. Alternatively, or in addition, flanking sequences may increase shRNA compatibility with polymerase II or polymerase III promoters, leading to more effective regulation of shRNA expression.

In some embodiments, the 5' flank sequence is selected from the sequences set forth in Table 13. Illustrative flank sequence are shown in Table 13.

TABLE 13

Illustrative flank sequences

| SEQ ID NO | |
|---|---|
| | 5' Flank Sequence |
| 956 | GG |
| 957 | ACACCAUGUUGCCAGUCUCUAGG |
| 958 | UGAUAGCAAUGUCAGCAGUGCCU |
| 959 | UAUUGCUGUUGACAGUGAGCGAC |
| | 3' Flank Sequence |
| 960 | UGGCGUCUGGCCCAACCACAC |
| 961 | GUAAGGUUGACCAUACUCUAC |

In some embodiments, the first and second sequence are present on a single stranded polynucleotide, wherein the first sequence and second sequence are separated by 4, 5, 6, 7, 8, 9, 10, 11, 12, 13, 14, or 15 nucleotides, wherein the 4, 5, 6, 7, 8, 9, 10, 11, 12, 13, 14, or 15 nucleotides form a loop region in the shRNA. In some embodiments, the loop region comprises a sequence selected from the sequences set forth in Table 14

TABLE 14

Illustrative loop region sequences

| SEQ ID NO | Loop Region Sequence |
|---|---|
| 962 | CGAA |
| 963 | UUCAAGA |
| 964 | AUAUUCA |
| 965 | UGUGCUGUC |
| 966 | CUCGAG |
| 967 | CUUCCUGUCAGA |
| 968 | CUUCCCUUUGUCAGA |
| 969 | GUGUUAUUCUUG |
| 970 | GUGUCUUAAUUG |
| 971 | GUGUUAGUCUUG |
| 972 | UCAAGAG |
| 973 | GGACAUCCAGGG |
| 974 | GUGAAGCCACAGAUG |
| 975 | GAUUCUAAAA | shRNAs of the disclosure may be generated exogenously by chemical synthesis, by in vitro transcription, or by cleavage of longer double-stranded RNA with Dicer or another appropriate nuclease with similar activity. Chemically synthesized siRNAs, produced from protected ribonucleoside phosphoramidites using a conventional DNA/RNA synthesizer, may be obtained from commercial suppliers such as Millipore Sigma (Houston, Tex.), Ambion Inc. (Austin, Tex.). Invitrogen (Carlsbad, Calif.), or Dharmacon (Lafayette, Colo.). siRNAs can be purified by extraction with a solvent or resin, precipitation, electrophoresis, chromatography, or a combination thereof, for example. Alternatively, siRNAs may be used with little if any purification to avoid losses due to sample processing.

In some embodiments, shRNAs of the disclosure can be produced using an expression vector into which a nucleic acid encoding the double stranded RNA has been cloned, for example under control of a suitable promoter.

Pharmaceutical Compositions

The disclosure provides pharmaceutical compositions comprising immune cells comprising the first and second receptors of the disclosure and a pharmaceutically acceptable diluent, carrier or excipient.

Such compositions may comprise buffers such as neutral buffered saline, phosphate buffered saline and the like; carbohydrates such as glucose, mannose, sucrose or dextrans, mannitol; proteins; polypeptides or amino acids such as glycine; antioxidants; chelating agents such as EDTA or glutathione; and preservatives.

In some embodiments, the immune cell expresses both the first receptor and the second receptor. In some embodiments, at least about 50%, about 55%, about 60%, about 65%, about 70%, about 75%, about 80%, about 85%, about 90%, or about 95% of the immune cells express both the first receptor and the second receptor. In some embodiments, at least 90% of the immune cells express both the first receptor and the second receptor.

Treating Cancer

Provided herein are methods of killing a plurality of cancer cells, or treating cancer, in a subject, comprising administering to the subject a therapeutically effective amount of a composition comprising immune cells comprising the first and second receptors of the disclosure. The immune cells express both receptors in the same cell.

Cancer is a disease in which abnormal cells divide without control and spread to nearby tissue. In some embodiments, the cancer comprises a liquid tumor or a solid tumor. Exemplary liquid tumors include leukemias and lymphomas. Cancers can arise in virtually an organ in the body, including epithelial tissues. Any cancer wherein a plurality of the cancer cells express the first, activator, ligand and do not express the second, inhibitor ligand is envisaged as within the scope of the instant disclosure. For example, CEA positive cancers that can be treated using the methods described herein include colorectal cancer, pancreatic cancer, esophageal cancer, gastric cancer, lung adenocarcinoma, head and neck cancer, gallbladder cancer, diffuse large B cell cancer or acute myeloid leukemia cancer.

In some embodiments, the plurality of cancer cells express the target antigen. In some embodiments, the plurality cancer cells of the subject express CEA. Any cancer whose cells express CEA, i.e. are CEA-positive, is envisaged as within the scope of the instant disclosure. Exemplary CEA-positive cancers include, but are not limited to, prostate, ovary, lung, thyroid, gastrointestinal, breast and liver cancers. Further CEA-positive cancers include colorectal cancer, pancreatic cancer, esophageal cancer, gastric cancer, lung cancer, head and neck cancer, gallbladder cancer, diffuse large B cell cancer or acute myeloid leukemia cancer. In some embodiments, the cancer comprises colon cancer, lung cancer or pancreatic cancer. In some embodiments, the CEA-positive cancer comprises lung cancer, colorectal cancer. In some embodiments, the lung cancer comprises lung adenocarcinoma, small cell lung cancer (SCLC), or non-small cell lung cancer (NSCLC). In some embodiments, the lung cancer comprises lung adenocarcinoma. The compositions and methods disclosure herein may be used to treat CEA-positive cancers that are relapsed, refractory and/or metastatic.

Provided herein are methods of treating CEA+ cancer in a subject having a CEA+ tumor, the tumor having loss of heterozygosity at an MHC class I locus. In some embodiments, the methods comprise administering to the subject an effective amount of the immune cells or pharmaceutical compositions described herein. In some embodiments, the methods comprise (a) determining HLA-A, HLA-B, or HLA-C genotype or expression of normal cells and a plurality of cancer cells of the subject; (b) determining the expression of CEA in a plurality of cancer cells of the subject; and (c) administering to the subject an effective amount of the immune cells or pharmaceutical compositions of the disclosure if the normal cells express an HLA-A, HLA-B or HLA-C non-target antigen 2 and the plurality of cancer cells do not express the HLA-A, HLA-B or HLA-C non-target antigen, and the plurality of cancer cells are also CEA-positive. In some embodiments, for example those embodiments where the cancer is known to be CEA+, the methods comprise (a) determining HLA-A, HLA-B or HLA-C genotype or expression of normal cells and a plurality of cancer cells of the subject; and (b) administering to the subject an effective amount of the immune cells or pharmaceutical compositions of the disclosure if the normal cells express an HLA-A, HLA-B or HLA-C non-target antigen and the plurality of cancer cells do not express the non-target antigen. In some embodiments, the non-target antigen comprises HLA-A*02, HLA-A*01, HLA-A*03, HLA-A*11, HLA-B*07 or HLA-C*07.

Administration of the immune cells or pharmaceutical compositions described herein can reduce the size of a tumor in the subject. In some embodiments, the size of the tumor is reduced by about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, or about 100%, relative to the size of the tumor before administration of the immune cells or pharmaceutical compositions. In some embodiments, the tumor is eliminated.

Administration of the immune cells or pharmaceutical compositions described herein can arrest the growth of a tumor in the subject. For example, the immune cells or pharmaceutical compositions can kill tumor cells, so that the tumor stops growing, or is reduced in size. In some cases, immune cells or pharmaceutical compositions can prevent formation of additional tumors, or reduce the total number of tumors in the subject.

Administration of the immune cells or pharmaceutical compositions described herein can result in selective killing of a cancer cell but not a wild-type cell in the subject. In some embodiments, about 60% of the cells killed are cancer cells, about 65% of the cells killed are cancer cells, about 70% of the cells killed are cancer cells, about 75% of the cells killed are cancer cells, about 80% of the cells killed are cancer cells, about 85% of the cells killed are cancer cells, about 90% of the cells killed are cancer cells, about 95% of the cells killed are cancer cells, or about 100% of the cells killed are cancer cells.

Administration of the immune cells or pharmaceutical compositions described herein can result in the killing of about 40%, about 50%, about 60%, about 70%, about 80%, about 90% or all of the cancer cells of the subject.

Administration of the immune cells or pharmaceutical compositions described herein can result in fewer side effects for the subject than administration of an otherwise equivalent immune cell comprising the first activator receptor but no second inhibitory receptor. For example, administering the immune cells or pharmaceutical compositions described herein can reduce dose limited toxicity relative to the CEA CAR, or CEA TCR administered without the second inhibitory receptor.

In some embodiments, a plurality of cancer cells do not express a polymorphic allele of TNFRSF11, ACHRB, ITGAE, TRPV1, or SREC. For example, the cancer cells have lost an allele of TNFRSF11, ACHRB, ITGAE, TRPV1, or SREC through loss of heterozygosity at that locus.

The disclosure provides methods of treating a cancer in a subject comprising: (a) determining the genotype of normal cells and a plurality of cancer cells of the subject at a polymorphic locus selected from the group consisting of rs1716 (ITGAE R950W), rs2976230 (ITGAE V1019A/V1019G), rs1805034 (TNFRSF11A V192A) and rs35211496 (TNFRSF11A H141Y); (b) determining the expression of CEA in a plurality of cancer cells; and (c) administering a plurality of immune cells to the subject if the wild-type cells are heterozygous for the polymorphic locus and the plurality of cancer cells are hemizygous for the polymorphic locus, and the plurality of cancer cells are CEA-positive, wherein the plurality of immune cells comprise: (i) a first receptor, optionally a chimeric antigen receptor (CAR) or T cell receptor (TCR), comprising an extracellular ligand binding domain specific to CEA cell adhesion molecule 5 (CEA), or a peptide antigen thereof in a complex with a major histocompatibility complex class I (MHC-I); and (ii) a second receptor, optionally an inhibitory receptor, comprising an extracellular ligand binding specific to a non-target antigen selected from TNFRSF11, ACHRB, ITGAE, TRPV1, and SREC, or an antigen peptide thereof in a complex with an a major histocompatibility complex class I (MHC-I), wherein the non-target antigen comprises a polymorphism.

Methods of genotyping cancer cells and normal cells from a subject for the presence or absence of SNPs will be readily apparent to persons of ordinary skill in the art. SNP genotyping methods include, inter alia, PCR based methods such as dual-probe TaqMan assays, array based hybridization methods and sequencing.

Methods of measuring the expression of the target antigen in cancer or wild-type cells from a subject will be readily apparent to persons of ordinary skill in the art. These include, inter alia, methods of measuring RNA expression such as RNA sequencing and reverse transcription polymerase chain reaction (RT-PCR), as well as methods of measuring protein expression such as immunohistochemistry based methods. Methods of measuring loss of heterozygosity in a plurality of cancer cells, include, inter alia, high throughput sequencing of genomic DNA extracted from cancer cells using methods known in the art.

In some embodiments, the first ligand comprises IMI-GVLVGV (SEQ ID NO: 2). In some embodiments, the first ligand is complexed with a major histocompatibility complex comprising a human leukocyte antigen A*02 allele (HLA-A*02).

In some embodiments, the plurality of cancer cells comprises a TNFRSF11A 192A allele at rs1805034, and the ligand binding domain of the second receptor has a higher affinity for a TNFRSF11A ligand with an V at position 192 of SEQ ID NO: 13 than for a TNFRSF11A ligand with an A at position 192 of SEQ ID NO: 13.

In some embodiments, the plurality of cancer cells comprises a TNFRSF11A 192V allele at rs1805034, and the ligand binding domain of the second receptor has a higher affinity for a TNFRSF11A ligand with an A at position 192 of SEQ ID NO: 13 than for a TNFRSF11A ligand with an V at position 192 of SEQ ID NO: 13.

In some embodiments, the plurality of cancer cells comprises a TNFRSF11A 141H allele at rs35211496, and the ligand binding domain of the second receptor has a higher affinity for a TNFRSF11A ligand with an Y at position 141 of SEQ ID NO: 13 than for a TNFRSF11A ligand with a H at position 141 of SEQ ID NO: 13.

In some embodiments, the plurality of cancer cells comprises a TNFRSF11A 141Y allele at rs35211496, and wherein the ligand binding domain of the second receptor has a higher affinity for a TNFRSF11A ligand with a H at position 141 of SEQ ID NO: 13 than for a TNFRSF11A ligand with a Y at position 141 of SEQ ID NO: 13.

In some embodiments, the plurality of cancer cells comprises an ITGAE 950R allele at rs1716, and the ligand binding domain of the second receptor has a higher affinity for an ITGAE ligand with a W at position 950 of SEQ ID NO: 14 than for an ITGAE ligand with an R at position 950 of SEQ ID NO: 14.

In some embodiments, the plurality of cancer cells comprises an ITGAE 950W at rs1716, and the ligand binding domain of the second receptor has a higher affinity for an ITGAE ligand with an R at position 950 of SEQ ID NO: 14 than for an ITGAE ligand with a W at position 950 of SEQ ID NO: 14.

In some embodiments, the plurality of cancer cells comprises an ITGAE 1019V allele at rs2976230, and the ligand binding domain of the second receptor has a higher affinity for an ITGAE ligand with an A or G at position 1019 of SEQ ID NO: 14 than for an ITGAE ligand with an W at position 1019 of SEQ ID NO: 14.

In some embodiments, the plurality of cancer cells comprises an ITGAE 1019A allele at rs2976230, and the ligand binding domain of the second receptor has a higher affinity for an ITGAE ligand with an V or G at position 1019 of SEQ ID NO: 14 than for an ITGAE ligand with an A at position 1019 of SEQ ID NO: 14.

In some embodiments, the plurality of cancer cells comprises an ITGAE 1019G allele at rs2976230, and the ligand binding domain of the second receptor has a higher affinity for an ITGAE ligand with a V or A at position 1019 of SEQ ID NO: 14 than for an ITGAE ligand with a G at position 1019 of SEQ ID NO: 14.

In some embodiments, the immune cells are T cells.

In some embodiments, the immune cells are allogeneic or autologous.

In some embodiments, the second receptor increases the specificity of the immune cells for the CEA-positive cancer cells compared to immune cells that express the first receptor but do not express the second receptor. In some embodiments, the immune cells have reduced side effects compared to immune cells that express the first receptor but do not express the second receptor.

Treating cancer can result in a reduction in size of a tumor. A reduction in size of a tumor may also be referred to as "tumor regression". Preferably, after treatment, tumor size is reduced by 5% or greater relative to its size prior to treatment; more preferably, tumor size is reduced by 10% or greater; more preferably, reduced by 20% or greater; more preferably, reduced by 30% or greater; more preferably, reduced by 40% or greater; even more preferably, reduced by 50% or greater; and most preferably, reduced by greater than 75% or greater. Size of a tumor may be measured by any reproducible means of measurement. The size of a tumor may be measured as a diameter of the tumor.

Treating cancer can result in a reduction in tumor volume. Preferably, after treatment, tumor volume is reduced by 5% or greater relative to its size prior to treatment; more preferably, tumor volume is reduced by 10% or greater; more preferably, reduced by 20% or greater; more preferably, reduced by 30% or greater; more preferably, reduced by 40% or greater; even more preferably, reduced by 50% or greater; and most preferably, reduced by greater than 75% or greater. Tumor volume may be measured by any reproducible means of measurement.

Treating cancer results in a decrease in number of tumors. Preferably, after treatment, tumor number is reduced by 5% or greater relative to number prior to treatment; more preferably, tumor number is reduced by 10% or greater; more preferably, reduced by 20% or greater; more preferably, reduced by 30% or greater; more preferably, reduced by 40% or greater; even more preferably, reduced by 50% or greater; and most preferably, reduced by greater than 75%. Number of tumors may be measured by any reproducible means of measurement. The number of tumors may be measured by counting tumors visible to the naked eye or at a specified magnification. Preferably, the specified magnification is 2×, 3×, 4×, 5×, 10×, or 50×.

Treating cancer can result in a decrease in number of metastatic lesions in other tissues or organs distant from the primary tumor site. Preferably, after treatment, the number of metastatic lesions is reduced by 5% or greater relative to number prior to treatment; more preferably, the number of metastatic lesions is reduced by 10% or greater; more preferably, reduced by 20% or greater; more preferably, reduced by 30% or greater; more preferably, reduced by 40% or greater; even more preferably, reduced by 50% or greater; and most preferably, reduced by greater than 75%. The number of metastatic lesions may be measured by any reproducible means of measurement. The number of metastatic lesions may be measured by counting metastatic lesions visible to the naked eye or at a specified magnification. Preferably, the specified magnification is 2×, 3×, 4×, 5×, 10×, or 50×.

Treating cancer can result in an increase in average survival time of a population of treated subjects in comparison to a population receiving carrier alone. Preferably, the average survival time is increased by more than 30 days; more preferably, by more than 60 days; more preferably, by more than 90 days; and most preferably, by more than 120 days. An increase in average survival time of a population may be measured by any reproducible means. An increase in average survival time of a population may be measured, for example, by calculating for a population the average length of survival following initiation of treatment with an active compound. An increase in average survival time of a population may also be measured, for example, by calculating for a population the average length of survival following completion of a first round of treatment with an active compound.

Treating cancer can result in an increase in average survival time of a population of treated subjects in comparison to a population of untreated subjects. Preferably, the average survival time is increased by more than 30 days; more preferably, by more than 60 days; more preferably, by more than 90 days; and most preferably, by more than 120 days. An increase in average survival time of a population may be measured by any reproducible means. An increase in average survival time of a population may be measured, for example, by calculating for a population the average length of survival following initiation of treatment with an active compound. An increase in average survival time of a population may also be measured, for example, by calculating for a population the average length of survival following completion of a first round of treatment with an active compound.

Treating cancer can result in increase in average survival time of a population of treated subjects in comparison to a population receiving monotherapy with a drug that is not a compound of the present disclosure, or a pharmaceutically acceptable salt, prodrug, metabolite, analog or derivative thereof. Preferably, the average survival time is increased by more than 30 days; more preferably, by more than 60 days; more preferably, by more than 90 days; and most preferably, by more than 120 days. An increase in average survival time of a population may be measured by any reproducible means. An increase in average survival time of a population may be measured, for example, by calculating for a population the average length of survival following initiation of treatment with an active compound. An increase in average survival time of a population may also be measured, for example, by calculating for a population the average length of survival following completion of a first round of treatment with an active compound.

Treating cancer can result in a decrease in the mortality rate of a population of treated subjects in comparison to a population receiving carrier alone. Treating cancer can result in a decrease in the mortality rate of a population of treated subjects in comparison to an untreated population. Treating cancer can result in a decrease in the mortality rate of a population of treated subjects in comparison to a population receiving monotherapy with a drug that is not a compound of the present disclosure, or a pharmaceutically acceptable salt, prodrug, metabolite, analog or derivative thereof. Preferably, the mortality rate is decreased by more than 2%; more preferably, by more than 5%; more preferably, by more than 10%; and most preferably, by more than 25%. A decrease in the mortality rate of a population of treated subjects may be measured by any reproducible means. A decrease in the mortality rate of a population may be measured, for example, by calculating for a population the average number of disease-related deaths per unit time following initiation of treatment with an active compound. A decrease in the mortality rate of a population may also be measured, for example, by calculating for a population the average number of disease-related deaths per unit time following completion of a first round of treatment with an active compound.

Treating cancer can result in a decrease in tumor growth rate. Preferably, after treatment, tumor growth rate is reduced by at least 5% relative to number prior to treatment; more preferably, tumor growth rate is reduced by at least 10%; more preferably, reduced by at least 20%; more preferably, reduced by at least 30%; more preferably, reduced by at least 40%; more preferably, reduced by at least 50%; even more preferably, reduced by at least 50%; and most preferably, reduced by at least 75%. Tumor growth rate may be measured by any reproducible means of measurement. Tumor growth rate can be measured according to a change in tumor diameter per unit time.

Treating cancer can result in a decrease in tumor regrowth. Preferably, after treatment, tumor regrowth is less than 5%; more preferably, tumor regrowth is less than 10%; more preferably, less than 20%; more preferably, less than 30%; more preferably, less than 40%; more preferably, less than 50%; even more preferably, less than 50%; and most preferably, less than 75%. Tumor regrowth may be measured by any reproducible means of measurement. Tumor regrowth is measured, for example, by measuring an increase in the diameter of a tumor after a prior tumor shrinkage that followed treatment. A decrease in tumor regrowth is indicated by failure of tumors to reoccur after treatment has stopped.

Treating or preventing a cancer can result in a reduction in the rate of cellular proliferation. Preferably, after treatment, the rate of cellular proliferation is reduced by at least 5%; more preferably, by at least 10%; more preferably, by at least 20%; more preferably, by at least 30%; more preferably, by at least 40%; more preferably, by at least 50%; even more preferably, by at least 50%; and most preferably, by at least 75%. The rate of cellular proliferation may be measured by any reproducible means of measurement. The rate of cellular proliferation is measured, for example, by measuring the number of dividing cells in a tissue sample per unit time.

Treating or preventing cancer can result in a reduction in the proportion of proliferating cells. Preferably, after treatment, the proportion of proliferating cells is reduced by at least 5%; more preferably, by at least 10%; more preferably, by at least 20%; more preferably, by at least 30%; more preferably, by at least 40%; more preferably, by at least 50%; even more preferably, by at least 50%; and most preferably, by at least 75%. The proportion of proliferating cells may be measured by any reproducible means of measurement. Preferably, the proportion of proliferating cells is measured, for example, by quantifying the number of dividing cells relative to the number of nondividing cells in a tissue sample. The proportion of proliferating cells can be equivalent to the mitotic index.

Treating or preventing cancer can result in a decrease in size of an area or zone of cellular proliferation. Preferably, after treatment, size of an area or zone of cellular proliferation is reduced by at least 5% relative to its size prior to treatment; more preferably, reduced by at least 10%; more preferably, reduced by at least 20%; more preferably, reduced by at least 30%; more preferably, reduced by at least 40%; more preferably, reduced by at least 50%; even more preferably, reduced by at least 50%; and most preferably, reduced by at least 75%. Size of an area or zone of cellular proliferation may be measured by any reproducible means of measurement. The size of an area or zone of cellular proliferation may be measured as a diameter or width of an area or zone of cellular proliferation.

Treating or preventing cancer can result in a decrease in the number or proportion of cells having an abnormal appearance or morphology. Preferably, after treatment, the number of cells having an abnormal morphology is reduced by at least 5% relative to its size prior to treatment; more preferably, reduced by at least 10%; more preferably, reduced by at least 20%; more preferably, reduced by at least 30%; more preferably, reduced by at least 40%; more preferably, reduced by at least 50%; even more preferably, reduced by at least 50%; and most preferably, reduced by at least 75%. An abnormal cellular appearance or morphology may be measured by any reproducible means of measurement. An abnormal cellular morphology can be measured by microscopy, e.g., using an inverted tissue culture microscope. An abnormal cellular morphology can take the form of nuclear pleiomorphism.

Dosage and Administration

The immune cells and of the present disclosure may be administered in a number of ways depending upon whether local or systemic treatment is desired.

In general, administration may be parenteral.

Methods for administration of cells for adoptive cell therapy are known and may be used in connection with the provided methods and compositions. For example, adoptive T cell therapy methods are described, e.g., in US Patent Application Publication No. 2003/0170238 to Gruenberg et al and U.S. Pat. No. 4,690,915 to Rosenberg.

The compositions of the disclosure are suitable for parenteral administration. As used herein, "parenteral administration" of a pharmaceutical composition includes any route of administration characterized by physical breaching of a tissue of a subject and administration of the pharmaceutical composition through the breach in the tissue, thus generally resulting in the direct administration into the blood stream, into muscle, or into an internal organ. Parenteral administration thus includes, but is not limited to, administration of a pharmaceutical composition by injection of the composition, by application of the composition through a surgical incision, by application of the composition through a tissue-penetrating non-surgical wound, and the like. In particular, parenteral administration is contemplated to include, but is not limited to, subcutaneous, intraperitoneal, intramuscular, intrasternal, intravenous, intraarterial, intrathecal, intraventricular, intraurethral, intracranial, intratumoral, intrasynovial injection or infusions; and kidney dialytic infusion techniques. In some embodiments, parenteral administration of the compositions of the present disclosure comprises intravenous or intraarterial administration.

The disclosure provides pharmaceutical compositions comprising a plurality of immune cells of the disclosure, and a pharmaceutically acceptable carrier, diluent or excipient.

Formulations of a pharmaceutical composition suitable for parenteral administration typically generally comprise of immune cells combined with a pharmaceutically acceptable carrier, such as sterile water or sterile isotonic saline. Such formulations may be prepared, packaged, or sold in a form suitable for bolus administration or for continuous administration. Injectable formulations may be prepared, packaged, or sold in unit dosage form, such as in ampoules or in multi-dose containers containing a preservative. Formulations for parenteral administration include, but are not limited to, suspensions, solutions, emulsions in oily or aqueous vehicles, pastes, and the like. Such formulations may further comprise one or more additional ingredients including, but not limited to, suspending, stabilizing, or dispersing agents. Parenteral formulations also include aqueous solutions which may contain excipients such as salts, carbohydrates and buffering agents. Exemplary parenteral administration forms include solutions or suspensions in sterile aqueous solutions, for example, aqueous propylene glycol or dextrose solutions. Such dosage forms can be suitably buffered, if desired. Formulations for parenteral administration may be formulated to be immediate and/or modified release. Modified release formulations include delayed-, sustained-, pulsed-, controlled-, targeted and programmed release.

In some embodiments, the formulated composition comprising the immune cells is suitable for administration via injection. In some embodiments, the formulated composition comprising the immune cells is suitable for administration via infusion.

The pharmaceutical compositions of the present disclosure, which may conveniently be presented in unit dosage form, may be prepared according to conventional techniques well known in the pharmaceutical industry. Such techniques include the step of bringing into association the immune cells with the pharmaceutical carrier(s) or excipient(s), such as liquid carriers.

Aqueous suspensions may further contain substances that increase the viscosity of the suspension including, for example, sodium carboxymethylcellulose, sorbitol and/or dextran. The suspension may also contain stabilizers.

The compositions of the present disclosure may additionally contain other adjunct components conventionally found in pharmaceutical compositions. Thus, for example, the compositions may contain additional, compatible, pharmaceutically-active materials such as, for example, antipruritics, astringents, local anesthetics or anti-inflammatory agents, or may contain additional materials useful in physically formulating various dosage forms of the compositions of the present disclosure, such as dyes, preservatives, antioxidants, opacifiers, thickening agents and stabilizers. However, such materials, when added, should not unduly interfere with the biological activities of the immune cells of the compositions of the present disclosure.

The formulation or composition may also contain more than one active ingredient useful for the particular indication, disease, or condition being treated with the immune cells, where the respective activities do not adversely affect one another. Such active ingredients are suitably present in combination in amounts that are effective for the purpose intended. Thus, in some embodiments, the pharmaceutical composition further includes other pharmaceutically active agents or drugs, such as chemotherapeutic agents.

The pharmaceutical composition in some aspects can employ time-released, delayed release, and sustained release delivery systems such that the delivery of the composition occurs prior to, and with sufficient time to cause, sensitization of the site to be treated. Many types of release delivery systems are available and known. Such systems can avoid repeated administrations of the composition, thereby increasing convenience to the subject and the physician.

Administration can be effected in one dose, continuously or intermittently throughout the course of treatment. Single or multiple administrations can be carried out with the dose level and pattern being selected by the treating physician.

The pharmaceutical composition in some embodiments contains the immune cells in amounts effective to treat or prevent a cancer, such as a therapeutically effective or prophylactically effective amount. Therapeutic or prophylactic efficacy in some embodiments is monitored by periodic assessment of treated subjects. For repeated administrations over days, weeks or months, depending on the condition, the treatment can be repeated until a desired suppression of cancer signs or symptoms occurs. However, other dosage regimens may be useful and can be determined. The desired dosage can be delivered by a single bolus administration or infusion of the composition or by multiple bolus administrations or infusions of the composition.

The cells or population of cells can be administrated in one or more doses. In some embodiments, an effective amount of cells can be administrated as a single dose. In some embodiments, an effective amount of cells can be administrated as more than one doses over a period time. Timing of administration is within the judgment of a managing physician and depends on the clinical condition of the patient.

The cells or population of cells may be obtained from any source, such as a blood bank or a donor, or the patient themselves.

An effective amount means an amount which provides a therapeutic or prophylactic benefit. The dosage administered will be dependent upon the age, health and weight of the recipient, kind of concurrent treatment, if any, frequency of treatment and the nature of the effect desired. In some embodiments, an effective amount of cells or composition comprising those cells are administrated parenterally. In some embodiments, administration can be an intravenous administration. In some embodiments, administration can be directly done by injection within a tumor.

For purposes of the disclosure, an assay, which comprises, for example, comparing the extent to which target cells are lysed or one or more cytokines are secreted by immune cells expressing the receptors, upon administration of a given dose of such immune cells to a mammal, among a set of mammals of which is each given a different dose of the immune cells, can be used to determine a starting dose to be administered to a mammal.

In some embodiments, the cells are administered as part of a combination treatment, such as simultaneously with or sequentially with, in any order, another therapeutic intervention, such as an antibody or engineered cell or receptor or agent, such as a cytotoxic or therapeutic agent. The immune cells of the disclosure are in some embodiments are co-administered with one or more additional therapeutic agents or in connection with another therapeutic intervention, either simultaneously or sequentially in any order. In some contexts, the immune cells are co-administered with another therapy sufficiently close in time such that the immune cell populations enhance the effect of one or more additional therapeutic agents, or vice versa. In some embodiments, the immune cells are administered prior to the one or more additional therapeutic agents. In some embodiments, the immune cells are administered after to the one or more additional therapeutic agents.

In embodiments, a lymphodepleting chemotherapy is administered to the subject prior to, concurrently with, or after administration (e.g., infusion) of adoptive immune cells. In an example, the lymphodepleting chemotherapy is administered to the subject prior to administration of the immune cells. For example, the lymphodepleting chemotherapy ends 1-4 days (e.g., 1, 2, 3, or 4 days) prior to adoptive cell infusion. In embodiments, multiple doses of adoptive cells are administered, e.g., as described herein. In embodiments, a lymphodepleting chemotherapy is administered to the subject prior to, concurrently with, or after administration (e.g., infusion) of the immune cells described herein. Examples of lymphodepletion include, but may not be limited to, nonmyeloablative lymphodepleting chemotherapy, myeloablative lymphodepleting chemotherapy, total body irradiation, etc. Examples of lymphodepleting agents include, but are not limited to, antithymocyte globulin, anti-CD3 antibodies, anti-CD4 antibodies, anti-CD8 antibodies, anti-CD52 antibodies, anti-CD2 antibodies, TCRαβ blockers, anti-CD20 antibodies, anti-CD19 antibodies, Bortezomib, rituximab, anti-CD 154 antibodies, rapamycin, CD3 immunotoxin, fludarabine, cyclophosphamide, busulfan, melphalan, Mabthera, Tacrolimus, alefacept, alemtuzumab, OKT3, OKT4, OKT8, OKT11, fingolimod, anti-CD40 antibodies, anti-BR3 antibodies, Campath-1H, anti-CD25 antibodies, calcineurin inhibitors, mycophenolate, and steroids, which may be used alone or in combination. As a further example, a lymphodepletion regimen can include, administration of alemtuzumab, cyclophosphamide, benduamustin, rituximab, pentostatin, and/or fludarabine. Lymphodepletion regimen can be administered in one or more cycles until the desired outcome of reduced circulating immune cells. In some embodiments, the lymphodepletion comprises administering an agent that specifically targets, and reduces or eliminates CD52+ cells in the subject, and the immune cells are modified to reduce or eliminate CD52 expression.

In some embodiments, an immune stimulating therapy is administered to the subject prior to, concurrently with, or after administration (e.g. infusion) of adoptive immune cells. In some embodiments, the immune stimulating therapy comprises homeostatic cytokines. In some embodiments, the immune stimulating therapy comprises immune-stimulatory molecules. In some embodiments, the immune stimulating therapy comprises IL-2, IL-7, IL-12, IL-15, IL-21, IL-9, or a functional fragment thereof. In some embodiments, the immune stimulating therapy comprises IL-2, IL-7, IL-12, IL-15, IL-21, IL-9, or combinations thereof. In some embodiments, the immune stimulating therapy comprises IL-2, or a functional fragment thereof.

Methods for adoptive cell therapy using autologous cells includes isolating immune cells from patient blood, performing a series of modifications on the isolated cells including transducing the cells with one or more vectors encoding the dual receptor system described herein, and administering the cells to a patient. Providing immune cells from a subject suffering from or at risk for cancer or a hematological malignancy requires isolation of immune cell from the patient's blood, and can be accomplished through methods known in the art, for example, by leukapheresis. During leukapheresis, blood from a subject is extracted and the peripheral blood mononuclear cells (PBMCs) are separated, and the remainder of the blood is returned to the subject's circulation. The PBMCs are stored either frozen or cryopreserved as a sample of immune cells and provided for further processing steps, such as, e.g. the modifications described herein.

In some embodiments, the method of treating a subject described herein comprises modifications to immune cells from the subject comprising a series of modifications comprising enrichment and/or depletion, activation, genetic modification, expansion, formulation, and cryopreservation.

The disclosure provides enrichment and/or depletion steps that can be, for example, washing and fractionating methods known in the art for preparation of subject PBMCs for downstream procedures, e.g. the modifications described herein. For example, without limitation, methods can include devices to remove gross red blood cells and platelet contaminants, systems for size-based cell fractionation for the depletion of monocytes and the isolation of lymphocytes, and/or systems that allow the enrichment of specific subsets of T cells, such as, e.g. CD4+, CD8+, CD25+, or CD62L+ T cells. Following the enrichment steps, a target sub-population of immune cells will be isolated from the subject PMBCs for further processing. Those skilled in the art will appreciate that enrichment steps, as provided herein, may also encompass any newly discovered method, device, reagent or combination thereof.

The disclosure provides activation steps that can be any method known in the art to induce activation of immune cells, e.g. T cells, required for their ex vivo expansion. Immune cell activation can be achieved, for example, by culturing the subject immune cells in the presence of dendritic cells, culturing the subject immune cells in the presence of artificial antigen-presenting cells (AAPCs), or culturing the immune cells in the presence of irradiated K562-derived AAPCs. Other methods for activating subject immune cells can be, for example, culturing the immune cells in the presence of isolated activating factors and compositions, e.g. beads, surfaces, or particles functionalized with activating factors. Activating factors can include, for example, antibodies, e.g. anti-CD3 and/or anti-CD28 antibodies. Activating factors can also be, for example, cytokines, e.g. interleukin (IL)-2 or IL-21. Activating factors can also be costimulatory molecules, such as, for example, CD40, CD40L, CD70, CD80, CD83, CD86, CD137L, ICOSL, GITRL, and CD134L. Those skilled in the art will appreciate that activating factors, as provided herein, may also encompass any newly discovered activating factor, reagent, composition, or combination thereof that can activate immune cells.

The disclosure provides genetic modification steps for modifying the subject immune cells. In some embodiments, the genetic modification comprises transducing the immune cell with a vector comprising a shRNA described herein complementary to B2M or HLA-A. In some embodiments, the genetic modification comprises modifying the genome of the immune cells to induce mutations in B2M or HLA-A using CRISPR/Cas mediated genome engineering. In some embodiments, the method comprises transducing the immune cell with one or more vectors encoding the activator and inhibitory receptors, thereby producing immune cells expressing the activator and inhibitory receptors.

The disclosure provides expansion steps for the genetically modified subject immune cells. Genetically modified subject immune cells can be expanded in any immune cell expansion system known in the art to generate therapeutic doses of immune cells for administration. For example, bioreactor bags for use in a system comprising controller pumps, and probes that allow for automatic feeding and waste removal can be used for immune cell expansion. Cell culture flasks with gas-permeable membranes at the base may be used for immune cell expansion. Any such system known in the art that enables expansion of immune cells for clinical use is encompassed by the expansion step provided herein. Immune cells are expanded in culture systems in media formulated specifically for expansion. Expansion can also be facilitated by culturing the immune cell of the disclosure in the presence of activation factors as described herein. Those skilled in the art will appreciate that expansion steps, as provided herein, may also encompass any newly discovered culture systems, media, or activating factors that can be used to expand immune cells.

The disclosure provides formulation and cryopreservation steps for the expanded genetically modified subject immune cells. Formulation steps provided include, for example, washing away excess components used in the preparation and expansion of immune cells of the methods of treatment described herein. Any pharmaceutically acceptable formulation medium or wash buffer compatible with immune cell known in the art may be used to wash, dilute/concentration immune cells, and prepare doses for administration. Formulation medium can be acceptable for administration of the immune cells, such as, for example crystalloid solutions for intravenous infusion.

Cryopreservation can optionally be used to store immune cells long-term. Cryopreservation can be achieved using known methods in the art, including for example, storing cells in a cryopreservation medium containing cryopreservation components. Cryopreservation components can include, for example, dimethyl sulfoxide or glycerol. Immune cells stored in cryopreservation medium can be cryopreserved by reducing the storage temperature to −80° C. to −196° C.

In some embodiments, the method of treatment comprises determining the HLA germline type of the subject. In some embodiments, the HLA germline type is determined in bone marrow.

In some embodiments, the method of treatment comprises determining the level of expression of CEA. In some embodiments, the level of expression of CEA is determined in tumor tissue samples from the subject. In some embodiments, the expression level of CEA is determined using next generation sequencing. In some embodiments, the expression level of CEA is determined using RNA sequencing. In some embodiments, the level of CEA is determined using immunohistochemistry.

In some embodiments, the method of treatment comprises administering a therapeutically effective dose of immune cells comprising an HLA-A*02 inhibitory receptor to a subject in need thereof, wherein the subject is determined to be HLA germline HLA-A*02 heterozygous and have cancer cells with loss of HLA-A*02. In some embodiments, the method of treatment comprises administering a therapeutically effective dose of immune cells comprising an HLA-A*01 inhibitory receptor to a subject in need thereof, wherein the subject is determined to be HLA germline HLA-A*01 heterozygous and have cancer cells with loss of HLA-A*01. In some embodiments, the method of treatment comprises administering a therapeutically effective dose of immune cells comprising an HLA-A*03 to a subject in need thereof, wherein the subject is determined to be HLA germline HLA-A*03 heterozygous and have cancer cells with loss of HLA-A*03. In some embodiments, the method of treatment comprises administering a therapeutically effective dose of immune cells comprising an HLA-A*07 inhibitory receptor to a subject in need thereof, wherein the subject is determined to be HLA germline HLA-A*07 heterozygous and have cancer cells with loss of HLA-A*07. In some embodiments, the method of treatment comprises administering a therapeutically effective dose of immune cells comprising an HLA-C*07 inhibitory receptor to a subject in need thereof, wherein the subject is determined to be HLA germline HLA-C*07 heterozygous and have cancer cells with and loss of HLA-C*07. In some embodiments, the method of treatment comprises administering a therapeutically effective dose of immune cells comprising an HLA-B*07 inhibitory receptor in a subject in need thereof, wherein the subject is determined to be HLA germline HLA-B*07 heterozygous and have cancer cells with loss of HLA-B*07.

In various embodiments, the disclosure provides method of treatment of heterozygous HLA-A*02 patients with malignancies that express CEA and have lost HLA-A*02 expression; and/or of treatment of heterozygous HLA-A*02 adult patients with recurrent unresectable or metastatic solid tumors that express CEA and have lost HLA-A*02 expression.

In some embodiments, a therapeutically effective dose of the immune cells described herein are administered. In some embodiments, the immune cells of the disclosure are administered by intravenous injection. In some embodiments, the immune cells of the disclosure are administered by intraperitoneal injection. In some embodiments, a therapeutically effective dose comprises about $0.5 \times 10^6$ cells, about $1 \times 10^6$ cells, about $2 \times 10^6$ cells, about $3 \times 10^6$ cells, $4 \times 10^6$ cells, about $5 \times 10^6$ cells, about $6 \times 10^6$ cells, about $7 \times 10^6$ cells, about $8 \times 10^6$ cells, about $9 \times 10^6$ cells, about $1 \times 10^7$, about $2 \times 10^7$, about $3 \times 10^7$, about $4 \times 10^7$, about $5 \times 10^7$, about $6 \times 10^7$, about $7 \times 10^7$, about $8 \times 10^7$, about $9 \times 10^7$, about $1 \times 10^8$ cells, about $2 \times 10^8$ cells, about $3 \times 10^8$ cells, about $4 \times 10^8$ cells, about $5 \times 10^8$ cells, about $6 \times 10^8$ cells, about $7 \times 10^8$ cells, about $8 \times 10^8$ cells, about $9 \times 10^8$ cells, about $1 \times 10^9$ cells, about $2 \times 10^9$ cells, about $3 \times 10^9$ cells, about $3 \times 10^9$ cells, about $4 \times 10^9$ cells, about $5 \times 10^9$ cells, about $5 \times 10^9$ cells, about $6 \times 10^9$ cells, about $7 \times 10^9$ cells, about $8 \times 10^9$ cells, about $9 \times 10^9$ cells, about $1 \times 10^{10}$ cells, about $2 \times 10^{10}$ cells, about $3 \times 10^{10}$ cells, about $4 \times 10^{10}$ cells, about $5 \times 10^{10}$ cells, about $6 \times 10^{10}$ cells, about $7 \times 10^{10}$ cells, about $8 \times 10^{10}$ cells, or about $9 \times 10^{10}$ cells.

In some embodiments, a therapeutically effective dose comprises about $0.5 \times 10^6$ cells to about $9 \times 10^{10}$ cells, about $1 \times 10^6$ cells to about $5 \times 10^{10}$ cells, about $2 \times 10^6$ cells to about $5 \times 10^9$ cells, about $3 \times 10^6$ cells to about $5 \times 10^9$ cells, about $4 \times 10^6$ cells to about $3 \times 10^9$ cells, about $5 \times 10^6$ cells to about $2 \times 10^9$ cells, about $6 \times 10^6$ cells to about $1 \times 10^9$ cells, $0.5 \times 10^6$ cells to about $6 \times 10^9$ cells, about $1 \times 10^6$ cells to about $5 \times 10^9$ cells, about $2 \times 10^6$ cells to about $5 \times 10^9$ cells, about $3 \times 10^6$ cells to about $4 \times 10^9$ cells, about $4 \times 10^6$ cells to about $3 \times 10^9$ cells, about $5 \times 10^6$ cells to about $2 \times 10^9$ cells, about $6 \times 10^6$ cells to about $1 \times 10^9$ cells, $0.5 \times 10^6$ cells to about $6 \times 10^8$ cells, about $1 \times 10^6$ cells to about $5 \times 10^8$ cells, about $2 \times 10^6$ cells to about $5 \times 10^8$ cells, about $3 \times 10^6$ cells to about $4 \times 10^8$ cells, about $4 \times 10^6$ cells to about $3 \times 10^8$ cells, about $5 \times 10^6$ cells to about $2 \times 10^8$ cells, about $6 \times 10^6$ cells to about $1 \times 10^8$ cells, about $7 \times 10^6$ cells to about $9 \times 10^8$ cells, about $8 \times 10^6$ cells to about $8 \times 10^8$ cells, about $9 \times 10^6$ cells to about $7 \times 10^8$ cells, about $1 \times 10^7$ cells to about $6 \times 10^8$ cells, about $2 \times 10^7$ cells to about $5 \times 10^8$ cells, about $7 \times 10^6$ cells to about $9 \times 10^7$ cells, about $8 \times 10^6$ cells to about $8 \times 10^7$ cells, about $9 \times 10^6$ cells to about $7 \times 10^7$ cells, or about $2 \times 10^7$ cells to about $5 \times 10^7$ cells.

In some embodiments, a therapeutically effective dose comprises about $0.5 \times 10^5$ cells to about $9 \times 10^{10}$ cells. In some embodiments, a therapeutically effective dose comprises about $0.5 \times 10^6$ cells to about $1 \times 10^{10}$ cells. In some embodiments, a therapeutically effective dose comprises about $0.5 \times 10^6$ cells to about $5 \times 10^9$ cells. In some embodiments, a therapeutically effective dose comprises about $0.5 \times 10^6$ cells to about $1 \times 10^9$ cells. In some embodiments, a therapeutically effective dose comprises about $0.5 \times 10^6$ cells to about $6 \times 10^8$ cells. In some embodiments, a therapeutically effective dose comprises about $0.5 \times 10^6$ cells to about $9 \times 10^{10}$ cells. In some embodiments, a therapeutically effective dose comprises about $0.5 \times 10^7$ cells to about $1 \times 10^{10}$ cells. In some embodiments, a therapeutically effective dose comprises about $0.5 \times 10^7$ cells to about $5 \times 10^9$ cells. In some embodiments, a therapeutically effective dose comprises about $0.5 \times 10^7$ cells to about $1 \times 10^9$ cells. In some embodiments, a therapeutically effective dose comprises about $0.5 \times 10^7$ cells to about $6 \times 10^8$ cells. In some embodiments, a therapeutically effective dose comprises about $0.5 \times 10^8$ cells to about $9 \times 10^{10}$ cells. In some embodiments, a therapeutically effective dose comprises about $0.5 \times 10^8$ cells to about $1 \times 10^{10}$ cells. In some embodiments, a therapeutically effective dose comprises about $0.5 \times 10^8$ cells to about $5 \times 10^9$ cells. In some embodiments, a therapeutically effective dose comprises about $0.5 \times 10^8$ cells to about $1 \times 10^9$ cells. The term "about" as referred to in a therapeutically dose, can be, for example, $\pm 0.5 \times 10^6$ cells, $\pm 0.5 \times 10^7$ cells, or $0.5 \times 10^8$ cells.

Kits and Articles of Manufacture

The disclosure provides kits and articles of manufacture comprising the polynucleotides and vectors encoding the receptors described herein, and immune cells comprising the receptors described herein. In some embodiments, the kit comprises articles such as vials, syringes and instructions for use.

In some embodiments, the kit comprises a polynucleotide or vector comprising a sequence encoding one or more receptors of the disclosure.

In some embodiments, the kit comprises a plurality of immune cells comprising the first and second receptors as described herein. In some embodiments, the plurality of immune cells comprises a plurality of T cells.

In some embodiments, the kit further comprises instructions for use.

ENUMERATED EMBODIMENTS

The disclosure can be understood with reference to the following illustrative, enumerated embodiments:

1. An immune cell responsive to loss of heterozygosity in a cancer cell, comprising: (a) a first receptor, optionally a chimeric antigen receptor (CAR) or T cell receptor (TCR), comprising an extracellular ligand binding domain specific to a target antigen selected from: (i) a cancer cell-specific antigen, or a peptide antigen thereof in a complex with a major histocompatibility complex class I (MHC-I); or (ii) CEA cell adhesion molecule 5 (CEA), or a peptide antigen thereof in a complex with a major histocompatibility complex class I (MHC-I); and (b) a second receptor, optionally an inhibitory receptor, comprising an extracellular ligand binding domain specific to a non-target antigen selected from TNFRSF11A, ACHRB, ITGAE, TRPV1, SREC, CXCL16, COLEC12 and APCDD1, or an antigen peptide thereof in a complex with a major histocompatibility complex class I (MHC-I), wherein the non-target antigen comprises a polymorphism.

2. The immune cell of embodiment 1, wherein the target antigen is a cancer cell-specific antigen.

3. The immune cell of embodiment 1, wherein the target antigen is a peptide antigen of a cancer cell-specific antigen in a complex with a major histocompatibility complex class I (MHC-I).

4. The immune cell of embodiment 2 or embodiment 3, wherein the cancer cell is a colorectal cancer cell.

5. The immune cell of embodiment 2 or embodiment 3, wherein the cancer cell is a pancreatic cancer cell, esophageal cancer cell, gastric cancer cell, lung adenocarcinoma cell, head-and-neck cancer cell, diffuse large B cell cancer cell, or acute myeloid leukemia cancer cell.

6. The immune cell of embodiment 1, wherein the cancer cells express CEA.

7. The immune cell of embodiment 6, wherein the target antigen is CEA.

8. The immune cell of embodiment 1, wherein the target antigen is a peptide antigen of CEA in a complex with a major histocompatibility complex class I (MHC-I).

9. The immune cell of any one of embodiments 1-8, wherein the target antigen is expressed by a target cell.

10. The immune cell of any one of embodiments 1-9, wherein the non-target antigen is not expressed by the target cell.

11. The immune cell of any one of embodiments 1-9, wherein the non-target antigen is expressed by healthy cells.

12. The immune cell of any one of embodiments 1-11, wherein the healthy cells express both the target antigen and the non-target antigen.

13. The immune cell of any one of embodiments 1-12, wherein the first receptor and the second receptor together specifically activate the immune cell in the presence of the target cell.

14. The immune cell of embodiment 13, wherein the immune cell is a T cell.

15. The immune cell of embodiment 14, wherein the T cell is a CD8+ CD4− T cell.

16. The immune cell of any one of embodiments 9-15, wherein the target cell comprises a colorectal cancer cell, a pancreatic cancer cell, an esophageal cancer cell, a gastric cancer cell, a lung adenocarcinoma cell, a head and neck cancer cell, a diffuse large B cell cancer cell or an acute myeloid leukemia cancer cell.

17. The immune cell of any one of embodiments 1-16, wherein the CEA comprises a sequence that shares at least 95% identity to SEQ ID NO: 1.

18. The immune cell of any one of embodiments 1-16, wherein the peptide antigen of CEA is IMIGVLVGV (SEQ ID NO: 2).

19. The immune cell of any one of embodiments 1-18, wherein the MHC-I comprises a human leukocyte antigen A*02 allele (HLA-A*02).

20. The immune cell of any one of embodiments 1-19, wherein the first receptor is a T cell receptor (TCR).

21. The immune cell of any one of embodiments 1-19, wherein the first receptor is a chimeric antigen receptor (CAR).

22. The immune cell of embodiment 20 or 21, wherein the extracellular ligand binding domain of the first receptor comprises an antibody fragment, a single chain Fv antibody fragment (scFv), or a β chain variable domain (Vβ).

23. The immune cell of embodiment 20 or 21, wherein the extracellular ligand binding domain of the first receptor comprises a TCR α chain variable domain and a TCR β chain variable domain.

24. The immune cell of embodiment 22 or 23, wherein the extracellular ligand binding domain of the first receptor comprises complement determining regions (CDRs) selected from SEQ ID NOs: 3-12.

25. The immune cell of embodiment 23, wherein: (a) the TCR α chain variable domain comprises a CDR-1 of TSITA (SEQ ID NO: 3), a CDR-2 of IRSNER (SEQ ID NO: 4) and a CDR-3 comprising ATDLTSGGNYK (SEQ ID NO: 5), ATDFTSGGNYK (SEQ ID NO: 6), ATDLTTGGNYK (SEQ ID NO: 7) or ATDFTTGGNYK (SEQ ID NO: 8); and (b) the TCR β chain variable domain comprises a CDR-1 of KGHPV (SEQ ID NO: 9), a CDR-2 of FQNQEV (SEQ ID NO: 10), and a CDR-3 of ASSLGLGDYEQ (SEQ ID NO: 11) or ASSLGTGDYEQ (SEQ ID NO: 12).

The immune cell of embodiment 23, wherein: (a) the TCR α chain variable domain comprises a CDR-1 of SEQ ID NO: 9, a CDR-2 of SEQ ID NO: 10 and a CDR-3 of SEQ ID NO: 11 or SEQ ID NO: 12; and (b) the TCR β chain variable domain comprises a CDR-1 of SEQ ID NO: 3, a CDR-2 of SEQ ID NO: 4 and a CDR-3 comprising SEQ ID NO: 5, SEQ ID NO: 6, SEQ ID NO: 7 or SEQ ID NO: 8.

The immune cell of any one of embodiments 1-26, wherein the non-target antigen is a TNFRSF11A antigen that shares at least 95% identity to SEQ ID NO: 13 and the polymorphism is selected from: (a) A or V at position 192 of SEQ ID NO: 13, or (b) H or Y at position 141 of SEQ ID NO: 13.

The immune cell of any one of embodiments 1-26, wherein the non-target antigen is an ITGAE antigen that shares at least 95% identity to SEQ ID NO: 14 and the polymorphism is selected from (a) R or W at position 950 of SEQ ID NO: 14; or (b) V, A, or G at position 1019 of SEQ ID NO: 14.

29. An immune cell responsive to loss of heterozygosity in a cancer cell, comprising: (a) a first receptor, optionally a chimeric antigen receptor (CAR) or T cell receptor (TCR), comprising an extracellular ligand binding domain specific to CEA cell adhesion molecule 5 (CEA), or a peptide antigen thereof in a complex with a major histocompatibility complex class I (MHC-I); and (b) a second receptor, optionally an inhibitory receptor, comprising an extracellular ligand binding domain specific to a non-target antigen, wherein the non-target antigen comprises HLA-A*02.

30. The immune cell of embodiment 29, wherein the extracellular ligand binding domain of the first receptor does not recognize a CEA peptide antigen in a MHC-I complex comprising HLA-A*02.

31. The immune cell of embodiment 29 or 30, wherein the extracellular ligand binding domain of the first receptor comprises an antibody fragment, a single chain Fv antibody fragment (scFv), a β chain variable domain (Vβ), or a TCR α chain variable domain and a TCR β chain variable domain.

32. The immune cell of embodiment 29 or 30, wherein the extracellular ligand binding domain of the first receptor comprises an scFv.

33. The immune cell of embodiment 32, wherein the scFv comprises a sequence having at least 85%, at least 90%, at least 95%, at least 97% or at least 99% identity to any one of SEQ ID NOs: 64-70.

34. The immune cell of embodiment 32, wherein the scFv comprises a sequence of any one of SEQ ID NOs: 64-70.

35. The immune cell of embodiment 29-33, wherein the extracellular ligand binding domain of the first receptor comprises CDRs selected from the group consisting of SEQ ID NOs: 55-63.

36. The immune cell of any one of embodiments 29-35, wherein the extracellular ligand binding domain of the second receptor comprises an antibody fragment, a single chain Fv antibody fragment (scFv), a β chain variable domain (Vβ), or a TCR α chain variable domain and a TCR β chain variable domain.

37. The immune cell of any one of embodiments 29-35, wherein the extracellular ligand binding domain of the second receptor comprises an scFv.

38. The immune cell of embodiment 37, wherein the scFv comprises a sequence having at least 85%, at least 90%, at least 95%, at least 97% or at least 99% identity to any one of SEQ ID NOs: 91-102.

39. The immune cell of embodiment 37, wherein the scFv comprises a sequence of any one of SEQ ID NOs: 91-102.

40. The immune cell of any one of embodiments 29-39, wherein the extracellular ligand binding domain of the second receptor comprises CDRs selected from the group consisting of SEQ ID NOs: 103-114.

41. The immune cell of any one of embodiments 29-40, wherein the second receptor comprises a LILRB1 intracellular domain or a functional variant thereof.

42. The immune cell of embodiment 41, wherein the LILRB1 intracellular domain comprises a sequence at least 95% identical to SEQ ID NO: 126.

43. The immune cell of any one of embodiments 29-42, wherein the second receptor comprises a LILRB1 transmembrane domain or a functional variant thereof.

44. The immune cell of embodiment 43, wherein the LILRB1 transmembrane domain or a functional variant thereof comprises a sequence at least 95% identical to SEQ ID NO: 135.

45. The immune cell of any one of embodiments 29-44, wherein the second receptor comprises a LILRB1 hinge domain or functional variant thereof.

46. The immune cell of embodiment 45, wherein the LILRB1 hinge domain comprises a sequence at least 95% identical to SEQ ID NO: 134, SEQ ID NO: 127 or SEQ ID NO: 128.

47. The immune cell of any one of embodiments 29-46, wherein the second receptor comprises a LILRB1 intracellular domain and a LILRB1 transmembrane domain, or a functional variant thereof.

48. The immune cell of embodiment 47, wherein the LILRB1 intracellular domain and LILRB1 transmembrane domain comprises SEQ ID NO: 130 or a sequence at least 95% identical to SEQ ID NO: 130.

49. The immune cell of any one of embodiments 29-48, wherein the cancer cell is a colorectal cancer cell.

50. The immune cell of any one of embodiments 29-48, wherein the cancer cell is a pancreatic cancer cell, esophageal cancer cell, gastric cancer cell, lung adenocarcinoma cell, head-and-neck cancer cell, diffuse large B cell cancer cell, or acute myeloid leukemia cancer cell.

51. The immune cell of any one of embodiments 29-50, wherein the target antigen is expressed by a target cell.

52. The immune cell of any one of embodiments 29-51, wherein the non-target antigen is not expressed by the target cell.

53. The immune cell of embodiment 51 or 52, wherein the target cell is a colorectal cancer cell, a pancreatic cancer cell, an esophageal cancer cell, a gastric cancer cell, a lung adenocarcinoma cell, a head-and-neck cancer cell, a diffuse large B cell cancer cell, or an acute myeloid leukemia cancer cell.

54. The immune cell of any one of embodiments 29-53, wherein the non-target antigen is expressed by healthy cells.

55. The immune cell of any one of embodiments 29-54, wherein the healthy cells express both the target antigen and the non-target antigen.

56. The immune cell of any one of embodiments 29-55, wherein the first receptor and the second receptor together specifically activate the immune cell in the presence of the target cell.

57. The immune cell of embodiment 56, wherein the immune cell is a T cell.

58. The immune cell of embodiment 57, wherein the T cell is a CD8+ CD4− T cell.

59. The immune cell of any one of embodiments 29-58, wherein the CEA comprises a sequence that shares at least 95% identity to SEQ ID NO: 1.

60. The immune cell of any one of embodiments 29-59, wherein the first receptor is a chimeric antigen receptor (CAR).

61. A pharmaceutical composition, comprising a therapeutically effective amount of the immune cells of any one of embodiments 1-60.

62. The pharmaceutical composition of embodiment 61, further comprising a pharmaceutically acceptable carrier, diluent or excipient.

63. The pharmaceutical composition of embodiment 61 or 62, for use as a medicament in the treatment of cancer.

64. A polynucleotide system, comprising one or more polynucleotides comprising polynucleotide sequences encoding: (a) a first receptor, optionally a chimeric antigen receptor (CAR) or T cell receptor (TCR), comprising an extracellular ligand binding domain specific to a target antigen selected from: (i) a cancer cell-specific antigen, or a peptide antigen thereof in a complex with a major histocompatibility complex class I (MHC-I); or (ii) CEA cell adhesion molecule 5 (CEA), or a peptide antigen thereof in a complex with a major histocompatibility complex class I (MHC-I); and (b) a second receptor, optionally an inhibitory receptor, comprising an extracellular ligand binding domain specific to a non-target antigen selected from TNFRSF11A, ACHRB, ITGAE, TRPV1, SREC, CXCL16, COLEC12 and APCDD1, or an antigen peptide thereof in a complex with a major histocompatibility complex class I (MHC-I), wherein the non-target antigen comprises a polymorphism.

65. A polynucleotide system, comprising one or more polynucleotides comprising polynucleotide sequences encoding: (a) a first receptor, optionally a chimeric antigen receptor (CAR) or T cell receptor (TCR), comprising an extracellular ligand binding domain specific to CEA cell adhesion molecule 5 (CEA), or a peptide antigen thereof in a complex with a major histocompatibility complex class I (MHC-I); and (b) a second receptor, optionally an inhibitory receptor, comprising an extracellular ligand binding domain specific to a non-target antigen, wherein the non-target antigen comprises HLA-A*02.

66. A vector, comprising the one or more polynucleotides of embodiment 64 or 65.

67. A method of killing a plurality of cancer cell and/or treating cancer in a subject, comprising administering to the subject an effective amount of the immune cell of any one of embodiments 1-60 or the pharmaceutical composition of any one of embodiments 61-63.

68. The method of embodiment 67, wherein a plurality of cancer cells express the target antigen.

69. The method of embodiment 67 or 68, wherein a plurality of cancer cells do not express the non-target antigen.

70. The method of embodiment 69, wherein the plurality of cancer cells have lost the non-target antigen due to loss of heterozygosity (LOH).

71. A method of treating a cancer in a subject comprising:
(a) determining the genotype of normal cells and a plurality of cancer cells of the subject at a polymorphic locus selected from the group consisting of rs1716 (ITGAE R950W), rs2976230 (ITGAE V1019A/V1019G), rs1805034 (TNFRSF11A V192A) and rs35211496 (TNFRSF11A H141Y); (b) determining the expression of CEACAM5 in a plurality of cancer cells; and (c) administering a plurality of immune cells to the subject if the normal cells are heterozygous for the polymorphic locus and the plurality of cancer cells are hemizygous for the polymorphic locus, and the plurality of cancer cells are CEA-positive, wherein the plurality of immune cells comprise: (i) a first receptor, optionally a chimeric antigen receptor (CAR) or T cell receptor (TCR), comprising an extracellular ligand binding domain specific to CEA cell adhesion molecule 5 (CEA), or a peptide antigen thereof in a complex with a major histocompatibility complex class I (MHC-I); and (ii) a second receptor, optionally an inhibitory receptor, comprising an extracellular ligand binding domain specific to a non-target antigen selected from TNFRSF11A, ACHRB, ITGAE, TRPV1, and SREC, or an antigen peptide thereof in a complex with an a major histocompatibility complex class I (MHC-I), wherein the non-target antigen comprises a polymorphism.

72. A method of treating a cancer in a subject comprising: (a) determining HLA-A genotype or expression for normal cells and a plurality of cancer cells of the subject; (b) determining the expression of CEA in a plurality of cancer cells; and (c) administering a plurality of immune cells to the subject if the normal cells express HLA-A*02 and the plurality of cancer cells do not express HLA-A*02, and the plurality of cancer cells are CEA-positive, wherein the plurality of immune cells comprise: (i) a first receptor, optionally a chimeric antigen receptor (CAR) or T cell receptor (TCR), comprising an extracellular ligand binding domain specific to CEA cell adhesion molecule 5 (CEA), or a peptide antigen thereof in a complex with a major histocompatibility complex class I (MHC-I); and (ii) a second receptor, optionally an inhibitory receptor, comprising an extracellular ligand binding domain specific to a non-target antigen, wherein the non-target antigen comprises HLA-A*02.

73. A method of making a plurality of immune cells, comprising: (a) providing a plurality of immune cells, and (b) transforming the plurality of immune cells with the polynucleotide system of embodiment 64 or 65, or the vector of embodiment 66.

74. A kit comprising the immune cell of any one of embodiments 1-60 or the pharmaceutical composition of any one of embodiments 61-63.

75. The kit of embodiment 74, further comprising instructions for use.

76. A TCR comprising: (1) a TCR alpha chain comprising or consisting essentially of amino acids 1-270 of any one of SEQ ID NOS: 16-31, or a sequence at least 95% identical thereto; and (2) a TCR beta chain comprising or consisting essentially of amino acids 293-598 of any one of SEQ ID NOS: 16-31, or a sequence at least 95% identical thereto.

77. A TCR comprising: (a) a TCR alpha chain comprising amino acids 1-270 of SEQ ID NO: 16 and a TCR beta chain comprising amino acids 293-598 of SEQ ID NO: 16; (b) a TCR alpha chain comprising amino acids 1-270 of SEQ ID NO: 17 and a TCR beta chain comprising amino acids 293-598 of SEQ ID NO: 17; (c) a TCR alpha chain comprising amino acids 1-270 of SEQ ID NO: 18 and a TCR beta chain comprising amino acids 293-598 of SEQ ID NO: 18; (d) a TCR alpha chain comprising amino acids 1-270 of SEQ ID NO: 19 and a TCR beta chain comprising amino acids 293-598 of SEQ ID NO: 19; (e) a TCR alpha chain comprising amino acids 1-270 of SEQ ID NO: 20 and a TCR beta chain comprising amino acids 293-598 of SEQ ID NO: 20; (f) a TCR alpha chain comprising amino acids 1-270 of SEQ ID NO: 21 and a TCR beta chain comprising amino acids 293-598 of SEQ ID NO: 21; (g) a TCR alpha chain comprising amino acids 1-270 of SEQ ID NO: 22 and a TCR beta chain comprising amino acids 293-598 of SEQ ID NO: 22; (h) a TCR alpha chain comprising amino acids 1-270 of SEQ ID NO: 23 and a TCR beta chain comprising amino acids 293-598 of SEQ ID NO: 23; (i) a TCR alpha chain comprising amino acids 1-270 of SEQ ID NO: 24 and a TCR beta chain comprising amino acids 293-598 of SEQ ID NO: 24; (j) a TCR alpha chain comprising amino acids 1-270 of SEQ ID NO: 25 and a TCR beta chain comprising amino acids 293-598 of SEQ ID NO: 25; (k) a TCR alpha chain comprising amino acids 1-270 of SEQ ID NO: 26 and a TCR beta chain comprising amino acids 293-598 of SEQ ID NO: 26; (l) a TCR alpha chain comprising amino acids 1-270 of SEQ ID NO: 27 and a TCR beta chain comprising amino acids 293-598 of SEQ ID NO: 27; (m) a TCR alpha chain comprising amino acids 1-270 of SEQ ID NO: 28 and a TCR beta chain comprising amino acids 293-598 of SEQ ID NO: 28; (n) a TCR alpha chain comprising amino acids 1-270 of SEQ ID NO: 29 and a TCR beta chain comprising amino acids 293-598 of SEQ ID NO: 29; (o) a TCR alpha chain comprising amino acids 1-270 of SEQ ID NO: 30 and a TCR beta chain comprising amino acids 293-598 of SEQ ID NO: 30; or (p) a TCR alpha chain comprising amino acids 1-270 of SEQ ID NO: 31 and a TCR beta chain comprising amino acids 293-598 of SEQ ID NO: 31.

78. An immune cell, comprising the TCR of embodiment 76 or 77.

79. The immune cell of embodiment 78, further comprising a second receptor, optionally an inhibitory receptor, comprising an extracellular ligand binding domain specific to a non-target antigen selected from TNFRSF11A, ACHRB, ITGAE, TRPV1, SREC, CXCL16, COLEC12 and APCDD1, or an antigen peptide thereof in a complex with an a major histocompatibility complex class I (MHC-I), wherein the non-target antigen comprises a polymorphism.

EXAMPLES

The following Examples are intended for illustration only and do not limit the scope of the invention. Throughout the examples, the term "blocker antigen" is used to describe embodiments of a non-target antigen.

Example 1: Identification of TNFRS11A as a Blocker

The GISTIC TCGA database was searched to identify regions lost due to loss of heterozygosity in colorectal cancers. Chr18q: 35,237,593-37,208,54 was identified as the regions that was most frequently lost due to loss of heterozygosity in colorectal cancers. Surface proteins encoded on Chr. 18q were filtered for those expressed by normal colon cells.

These surface proteins were searched for nonsynonymous SNPS in the extracellular domains of the proteins using the following process:

The NCBI dbSNP database for common variants was downloaded (Note, for NCBI the "common" category is based on germline origin and a minor allele frequency (MAF) of >=0.01 in at least one major population, with at least two unrelated individuals having the minor allele)
This database was analyzed only variants in chromosome 18 and chromosome 17
Variants with MAF<0.1 were removed
VEP (Variant Effect Predictor) was run, and only missense variants that were in protein coding regions were kept
The following genes were removed:
  genes without transmembrane domains
  genes located in Golgi, ER, mitochondria, endosome, nucleus membrane
  genes that are not highly expressed in colon (GTEx expression level <5 TPM)
  genes that are amplified as opposed to deleted
  loss of heterozygosity of candidate genes was checked in the TCGA Copy Number Portal
  Candidate genes were checked for other variants in Ensembl Genome Browser
    If there are variants, the location of the variation was checked (is it in the extracellular domain?)
An overview of the filtering pipeline is shown in Table 15 below.

TABLE 15

Identification of candidate blocker targets on Chromosome 17 and 18.

| No. of genes (total) | TM genes | MAF > 0.1 chr18q OR chr17p | Expression in Colon-Transverse > 5 TPM | Genes after removal of CNA amplifications, only HOMDEL shown | VEP (protein-coding, missense variants) | Not in Golgi, ER, mitochondria, endosome, nucleus membrane | In ECD |
|---|---|---|---|---|---|---|---|
| 20,365 | 5177 | 255 | 132 | 72 | 23 | 13 | 5 |

CNA: Copy number amplification

TPM: Transcripts per Kilobase Million (The Genotype-Tissue Expression, GTEx project, gtexportal.org/home)

Five candidate genes passed all filters. A summary of these five genes is shown in Tables 16-19 below.

TABLE 16

Expression.

| | | Expression (RPKM) GTEx-Normal | | Expression (RPKM) CCLE Colorectal Cancer Cell Line | | |
|---|---|---|---|---|---|---|
| Entry name | Gene names | Colon - Sigmoid | Colon - Transverse | HS255T_FIBROBLAST (ACH-000199) | HS675T_FIBROBLAST (ACH-000214) | HS698T_FIBROBLAST (ACH-000850) |
| TNR11_HUMAN | TNFRSF11A RANK | 0.7953 | 9.33 | 0.02581 | 0.00609 | 0.04472 |
| ACHB_HUMAN | CHRNB1 ACHRB CHRNB | 5.172 | 4.861 | 2.55857 | 4.50562 | 1.21823 |
| ITAE_HUMAN | ITGAE | 7.72 | 6.5555 | 7.73753 | 5.3983 | 4.82732 |
| TRPV1_HUMAN | TRPV1 VR1 | 6.978 | 8.0955 | 0.0613 | 0 | 0.04903 |
| SREC_HUMAN | SCARF1 KIAA0149 SREC | 8.325 | 11.15 | 0.22201 | 0.24929 | 0.07219 |

TABLE 17

Position, Characteristics and Variation

| Entry name | Cytoband | Freq of del. | Result | Impact | Biotype | Protein Pos. | Amino Acids | Codons | MAF | ECD |
|---|---|---|---|---|---|---|---|---|---|---|
| TNR11_HUMAN | 18q21.33 | 0.026 | MS | Mod. | PC | 192 | A/V | gCg/ gTg | 0.5942 | yes |
| ACHB_HUMAN | 17p13.1 | 0.013 | MS | Mod. | PC | 32 | E/G | gAg/ gGg | 0.1206 | yes |
| ITAE_HUMAN | 17p13.2 | 0.01 | MS | Mod. | PC | 950*, 1019 | R/W | Cgg/ Tgg | 0.2654 | yes |
| TRPV1_HUMAN | 17p13.2 | 0.01 | MS | Mod. | PC | 585*, 469, 459 | I/V | Atc/ Gtc | 0.3177 | yes |

TABLE 17-continued

Position, Characteristics and Variation

| Entry name | Cytoband | Freq of del. | Result | Impact | Biotype | Protein Pos. | Amino Acids | Codons | MAF | ECD |
|---|---|---|---|---|---|---|---|---|---|---|
| SREC_HUMAN | 17p1.3 | 0.008 | MS | Mod. | PC | 425*, 339 | A/V | gCg/ gTg | 0.333 | yes |

MS: missense variant
Mod.: Moderate
PC: Protein Coding
Pos.: Position
*indicate protein positions with the indicated amino acids and codons
MAF: minor allele frequency

TABLE 18

Copy Number

| Entry name | Frequency of deletion, overall | Uniprot ECD residue range |
|---|---|---|
| TNR11_HUMAN | 0.6786 | 30-212 |
| ACHB_HUMAN | 0.5607 | 24-244 |
| ITAE_HUMAN | 0.5248 | 19-1124 |
| TRPV1_HUMAN | 0.5231 | 455-471 |
| SREC_HUMAN | 0.5162 | 20-421 |

Results in Table 18 are from the TCGA Copy Number Portal.

The crystal structures were examined to verify the accessibility of the extracellular domain SNPs to an antibody.

Using these methods, TNFRS11A (RANK) was identified as a target for a blocker receptor to pair with a CEA TCR or CAR activator. The TNFRSF11A (RANK) receptor is expressed in a wide range of normal tissues, including the gut. Gut expression includes expression in the colon, wherein the median normal TNFRSF11A colon expression is 23 transcripts/cell. Maximum CRC CEA expression in the colon is 8,780 transcripts/cell. TNFRSF11A is also expressed in the esophagus. The median normal esophagus TNFRSF11A expression is 2 transcripts/cell. Maximum EsCa CEA expression in the esophagus is 6,208 transcripts/cell. TNFRSF11A encodes a 616-residue protein that binds RANKL (the target of denosumab). It includes a 28 amino acid signal peptide, a 184 amino acid extracellular domain, a 21 amino acid transmembrane domain and a 383 amino acid intracellular domain. TNFRSF11A contains two common nonsynonymous variants, rs1805034 (V192A) which has an MAF of 0.4, and rs35211496 (H141Y) which has MAF of about 0.2.

Example 2: CEA CAR Mediated Activation of Jurkat Cells is Blocked by an HLA-A*2 Inhibitory Receptor Cell Culture Jurkat cells encoding an NFAT Luciferase reporter were obtained from BPS Bioscience. In culture, Jurkat cells were maintained in RPMI media supplemented with 10% FBS, 1% Pen/Strep and 0.4 mg/mL G418/Geneticin. HeLa cells were maintained as suggested by ATCC.

Jurkat Cell Transfection

Jurkat cells were transiently transfected via 100 uL format 4D-Nucleofactor™ (Lonza) according to manufacturer's protocol using the settings for Jurkat cells. Cotransfection was performed with 1-3 ug of activator construct and 1-3 ug of blocker constructs or empty vector per 1e6 cells and recovered in RPMI media supplemented with 20% heat-inactivated FBS and 0.1% Pen/Strep.

Jurkat-NFAT-Luciferase Activation Studies

Figure 10:
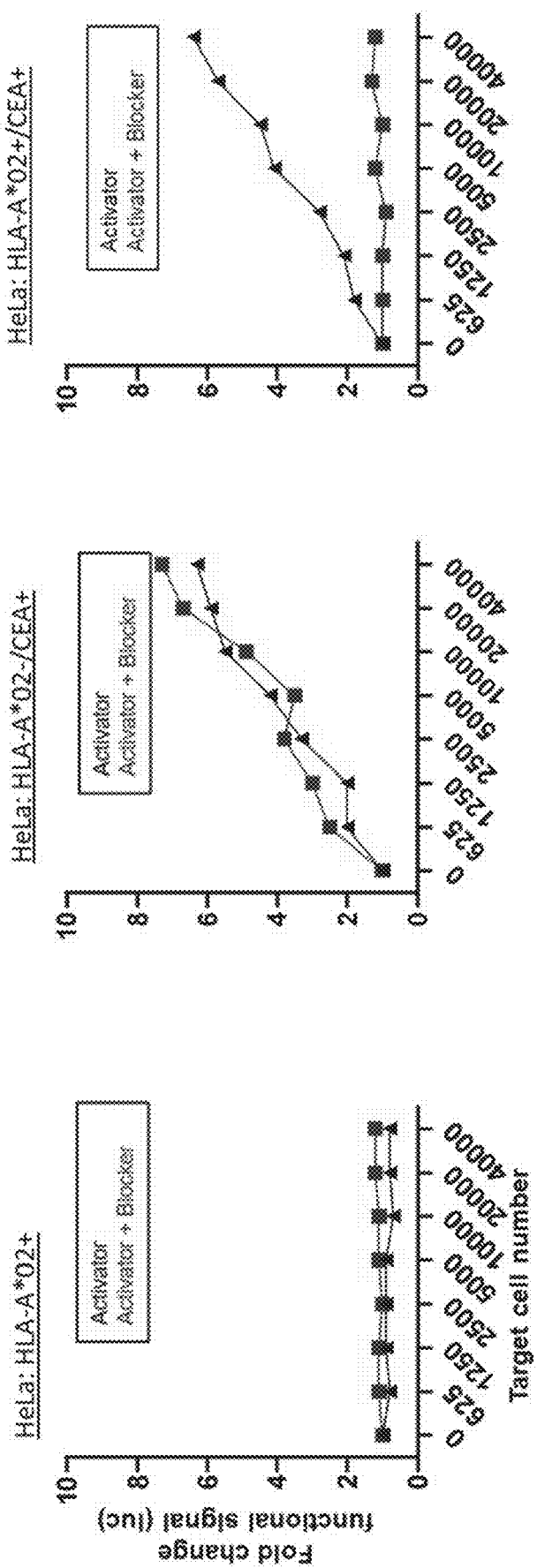
FIG. 10 is a series of plots showing that an HLA-A*02 inhibitory receptor can block activation of Jurkat cells by a CEA CAR.

HeLa cells expressing HLA-A*02, CEA or both, were co-cultured with Jurkat cells, and Jurkat cell activation was assayed using the NFAT-luciferase reporter system. The ability of a blocker receptor with an HLA-A-A*02 antigen binding domain and a LIR-1 ICD (C1765) to block activation of Jurkat cells expressing an activator CAR with an CEA scFv (CT618) was assayed. HeLa cells were transduced with polynucleotides encoding HLA-A*02+ and/or CEA+ to generate HLA-A*02+/CEA− HeLa cells, HLA-A*02−/CEA+ HeLa cells and CEA+/HLA-A*02+ HeLa cells to use as target cells for Jurkat cell activation assays. These HeLa cells were co-cultured with Jurkat cells, and Jurkat cell activation was assayed using the NFAT Luciferase reporter system. The results are shown in FIG. 10. As can be seen in FIG. 10, an HLA-A*02 LIR1 blocker can inhibit Jurkat cell activation by a CEA scFv CAR when Jurkat cells are cultured with CEA+/HLA-A*02+ target cells.

Example 3: Identification of Additional Blocker Target Antigens

Figure 11:
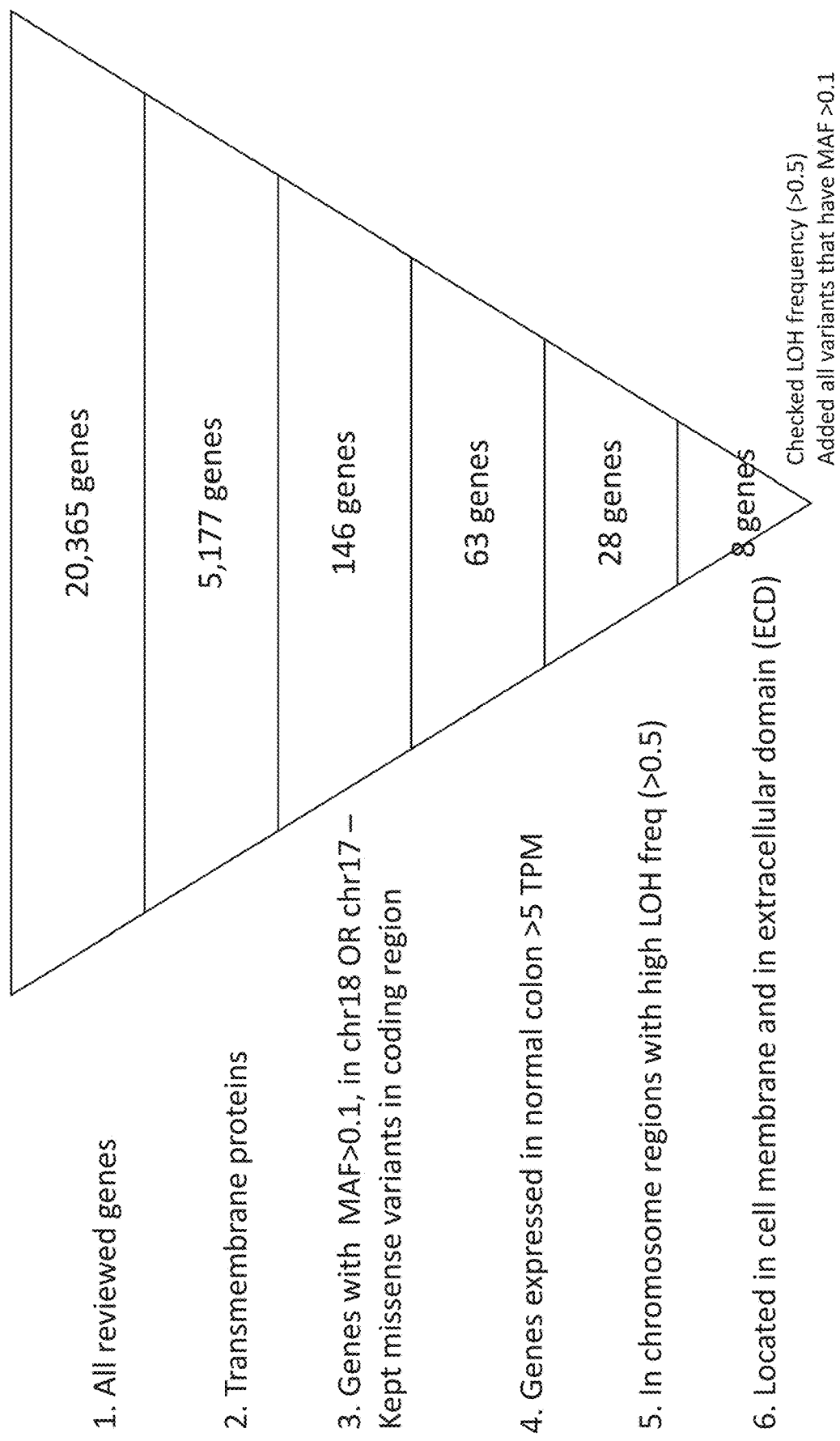
FIG. 11 is a diagram showing the bioinformatics search process used to identify potential non-target antigen (blocker) candidate genes.

A bioinformatics pipeline similar to the one used to identify TNFRSF11A in Example 1 was used to identify additional candidate blocker targets. The set of human genes was searched for genes with common nonsynonymous variants in extracellular domains that have high loss of heterozygosity (greater than 0.5) in colorectal cancers. Genes with nonsynonymous variants were searched in dbSNP, a database of single nucleotide polymorphisms, that also includes. small-scale insertions and deletions along with publication, population frequency, molecular consequence, and genomic mapping information. Common variations were defined as having a minor allele frequency (MAF) of greater than or equal to 0.01 in at least one major population and with at least two unrelated individuals having the minor allele in NCBI. MAF of greater than or equal to 0.1 as criterion for common variations. The focus was on chromosomes 17 and 18, as these chromosomes have high LOH in colorectal cancers. Genes were filtered for membrane proteins, colon expression, and common nonsynonymous variants in the extracellular domain, as described above. A summary of the search process is shown in FIG. 11.

Additional databases used in this analysis include the following: Uniprot (The Universal Protein Resource), which was used resource for protein sequence and annotation data hosted by EMBL-EBI, SIB and PIR. GTEx (The Genotype-Tissue Expression) was use as a public resource for tissue-specific gene expression and regulation. It contains samples from 54 non-diseased tissue sites across nearly 1000 individuals. TCGA (The Cancer Genome Atlas) was used as a resource for over 20,000 primary cancer and matched normal samples spanning 33 cancer types. The TCGA-COADREAD dataset is a Colon Adenocarcinoma and Rectum Adenocarcinoma dataset. CCLE (Cancer cell line Encyclopedia) contains information on 57 Colorectal Cancer (CRC) cell lines.

RNASeqDB is database of processed data from the GTEx and TCGA using the same pipeline which allows comparative studies from Memorial Sloan Kettering Cancer Center. 372 TCGA-COADREAD samples and 339 normal colon samples from GTEx were analyzed.

COLEC12, CXCL16 and APCDD1 were identified using these methods as potential blocker targets. Table 19 summarizes the expression data for these genes in colorectal cancers. Expression data from UCSC Xena browser (for TCGA) and CCLE samples.

TABLE 19

| | | Expression | | |
|---|---|---|---|---|
| Gene name | TCGA-Colorectal Adenocarcinoma (Median-FPKM (383 samples) | Median expression_CCLE_ colorectal_RPKM (57 cell lines) | Colon - Sigmoid | Colon - Transverse |
| CXCL16 | 5.7509 | 25.88884 | 11.51 | 15.44 |
| COLEC12 | −0.6416 | 0.01964 | 27.25 | 11.24 |
| APCDD1 | 4.1498 | 0.58982 | 12.26 | 11.22 |

Table 20 summarizes the variants and minor allele frequencies.

TABLE 20

| | | Position, Characteristics and Variation | | | |
|---|---|---|---|---|---|
| Gene names | All variants | TCGA-Colorectal Adenocarcenoma_Frequency of heterozygous deletion (score = −1) | Protein position of Amino Acid Change | Amino acid Change | MAF |
| CXCL16 | rs2277680, rs1050998 | 0.569805195 | 1.200, 2.142 | 1. A/V, 2. I/T | 1. 0.4615, 2. 0.4633 |
| COLEC12 | rs2305025 | 0.584415584 | 522 | S/P | 0.6252 |
| APCDD1 | rs1786683 | 0.600649351 | 165 | Y/S | 0.2496 |

TABLE 21

| | LOH Frequencies in Various Cancers | | |
|---|---|---|---|
| | | LOH Freq | |
| | COLEC12 | CXCL16 | APCDD1 |
| All cancers | 0.23 | 0.36 | 0.23 |
| CRC | 0.59 | 0.58 | 0.6 |
| Lung | 0.3 | 0.58 | 0.29 |
| Pancreatic | 0.3 | 0.48 | 0.28 |
| Ovarian | 0.39 | 0.74 | 0.36 |
| DBCL | 0.15 | 0.23 | 0.13 |
| Blood | 0.06 | 0.11 | 0.05 |
| variant | S/P | I/T | Y/S |
| MAF | 0.63 | 0.46 | 0.25 |

Example 4: Identification of Antigen Binding Domains Specific to Blocker Target Antigens Publicly available antibodies to candidate blocker antigens are sequenced, if CDR sequences are unknown. If no antibodies to candidate blocker targets are available, these antibodies are generated by immunization of mice, rats, or rabbits with purified protein (e.g., COLEC12, CXCL16, TNFRS11A and other targets described in the Examples). Sera from immunized animals is used to screen for mAbs for binding to blocker targets. Antibodies to blocker targets are also generated using the huTARG system. Antibodies with the desired specificity are then isolated and sequenced to determine CDR sequences.

CDR sequence from antibodies to blocker targets are used to generate scFv using standard molecular biology techniques. Candidate scFv are fused to inhibitory receptor hinge or transmembrane domains to generate inhibitory receptors using standard molecular biology techniques. Candidate scFv are also fused to activator receptor hinge or transmembrane domains (e.g., CAR) to generate full length activator receptors to use as a positive control for scFv binding to target antigens. The ability of candidate scFv to work in the context of an inhibitory receptor is assayed in Jurkat cells using the NFAT-luciferase reporter assay.

Example 5: Methods for Examples 6-11

Cell Line Generation

Target cell lines were grown per vendor instructions. Genetic modifications to construct CEA(−) HLA-A*02(−) cell lines as shown in Table 25 used CRIPSR/Cas9. Guide RNAs were purchased from Synthego and/or IDT (Integrated DNA Technologies) and the targeting sequences are listed in Table 22. To form RNP complexes S.p. HiFi Cas9 protein (IDT) was mixed with sgRNAs at 1:3 molar ratios before electroporation with settings tailored for each cell line using the 4D Nucleofector (Lonza).

To generate CEA(+) HLA-A*02(+) and CEA(+) HLA-A*02(−) HeLa cell lines, pLenti plasmid encoding CEA with or without a plasmid encoding HLA-A*02 was transfected into HeLa cells. Stable pools expressing CEA and/or HLA-A*02 were enriched by FACS and expanded afterwards.

To establish HLA-A*02(+) K562 and Colo668 lines, lentivirus encoding HLA-A*02 heavy chain was transduced to create stable pools. To generate CEA(+) target cells, all CEA(−) target cells, except for Colo668 and H508, were transfected with CEA mRNA (see below) using 4D Nucleofector, and assayed within 1-3 days post transfection. Lentivirus encoding Renilla luciferase and RFP (in cis) was purchased from Biosettia and transduced to establish stable pools of RFP-expressing target cells. The target knockout or over-expressing cell lines were enriched for target-negative or -positive pools by FACS using an HLA-A*02 antibody (BV421, BioLegend, Cat #343326), or CEA antibody (R&D systems, MAB41281). RFP-expressing pools of target cell lines were selected by FACS.

CEA CAR with or without the A*02 blocker was stably expressed in luciferase-reporter Jurkat cells by lentiviral transduction.

In Vitro Transcription of mRNAs mRNA was synthesized in 25 μl of 1× reaction buffer containing 40 mM Tris-HCL, 10 mM dithiothreitol, 2 mM spermidine, 0.002% Triton X-100, 27 mM magnesium acetate, 5 mM CleanCap Cap 1 AG trimer (TriLink), and 5 mM each of ATP, CTP, GTP, and pseudo-uridine triphosphate (NEB). The reaction proceeded 2 hours at 37° C. with final concentrations of 8 U/L T7 RNA polymerase (NEB, M0460T), 0.002 U/L inorganic pyrophosphatase (NEB, M2403L), 1 U/L murine RNase inhibitor (NEB, M0314L), and 0.025 μg/L linearized-T7-template. 0.4 U/L DNase I (NEB, M0303L) was added at the end of the reaction at 37° C. for 15 min in 1× DNase I buffer to remove template. poly(A) tailing of RNAs was performed per manufacturer's protocols with $E.\ coli$ poly (A) polymerase (NEB, M0276) and RNAs were purified by a supplier's cleanup kit (NEB, T2040L). RNAs were treated with 0.2 U/g Antarctic phosphatase (NEB, M0289L) in 1× Antarctic phosphatase buffer for 1 hour and repurified by (NEB, T2040L). RNA concentrations were measured by Nanodrop and examined on 1% Agarose gels.

Flow Cytometry for Probe Binding and Receptor Expression

The expression of CARs and TCRs were assessed via flow cytometry using biotinylated protein L (ThermoFisher #29997) followed by fluorescently labeled streptavidin (for CARs), or fluorescently labeled anti-murine TRBV antibody (for TCRs; Biolegend C1:H57-597). Blocker-antigen binding was determined by staining Tmod-expressing Jurkat cells with biotinylated-pMHCs probes, tetramerized and prelabeled with streptavidin conjugated to an appropriate fluorochrome (Biolegend). After staining at 4° C., median fluorescence intensity (MFI) was determined using a FACS Canto II flow cytometer (BD Biosciences).

Jurkat Cell Functional Assay

Target cells expressing activator and blocker antigen natively, recombinantly, or transiently by mRNA transfection were used in this study. If mRNA transfection was used, each pair of target cells (HLA-A*02(−) and HLA-A*02(+)) were electroporated using 4D Nucleofactor (Lonza) with variable amounts of CEA mRNA, starting from 2 μg mRNA in a 9-fold dilution series for a total of 6-16 points. Electroporated cells or cells natively/stably expressing the target antigen were seeded and grown under normal tissue culture conditions at a density of 10,000 cells/well in 384-well plates (Corning, Cat #3570) for 18-20 hours. 12,000 Jurkat cells, wild type or expressing CEA CAR or CEA Tmod constructs, were added to target cell wells and co-cultured for 6 hours before luciferin substrate was added to measure the luciferase signal using a Tecan Infinite M1000.

To quantify CEA expression, target cells from each CEA mRNA titration point were seeded in a 96-well plate (Corning, Cat #3610) and grown for 18-20 hours before cell collection. CEA expression was quantified using CEA antibody (R&D systems, MAB41281) and QIFIKIT (Agilent, K007811-8) according to the manufacturer's protocol to determine surface CEA molecule numbers. Standard curves were generated for cell surface number vs. mRNA (see below).

Conversion of EC50 and IC50 Molecules/Cell Value into TPM

To generate protein molecules/cell vs. TPM standard curves, the surface expression of CEA or HLA-A*02 on multiple cell lines was either determined in-house as described above or taken from previously published results. The TPM values were from DepMap portal (depmap.org/portal/). The slope (k) was determined by fitting molecules/cell=k*TPM, and used to convert EC50 and IC50 in molecules/cell to TPM for comparison to tissue and cell line antigen expression values.

Primary T Cell Generation and Characterization

Informed-consent for primary T cells and donor collection protocols were approved by an Institutional Review Board (IRB) at Allcells®. Allcells® followed HIPAA compliance and approved protocols (www.allcells.com/cell-tissue-procurement/donor-facilities/). PBMCs were purified from Leukopaks purchased from Allcells®. LymphoONE™ media (Takara WK552) was supplemented with 1% human AB Serum (GeminiBio 100-512) unless otherwise stated. Human PBMCs were grown in LymphoONE™ and supplemented with TransAct™ (Miltenyi 130-111-160) following the manufacturers guidelines (1:100 dilution) for 24 hours before transduction with CEA CAR-alone and CEA Tmod-encoding lentivirus. Additional LymphoONE™ supplemented with IL-2 (300 IU/ml) was added 24 hours after transduction to transduced cells which were cultured for 3 days before transfer to a 24-well G-Rex plate (Wilson Wolf 80192M). Fresh IL-2 (300 IU/ml) was added every 48 hours with media change every 7 days during expansion in G-Rex plates. Expression and antigen binding of transduced CARs or Tmod components in primary T cells were confirmed by flow cytometry as described above.

For in vivo studies, CEA CAR and CEA Tmod were generated as described above with the use of G-Rex10 (Wilson Wolf 80040S) or G-Rex100 (Wilson Wolf 80500) to accommodate the larger quantity of cells beginning on day 3. T cells were counted, and media was exchanged every other day starting on day 3. Enrichment of CAR- and Tmod-expressing cells was performed on day 9.

To enrich CAR- or Tmod dual receptor-expressing population, cells were labeled with protein L-biotin (Thermo Scientific Cat #29997) streptavidin-PE or probe-biotin/streptavidin-PE, followed by anti-PE microbeads (Miltenyi 130-048-801) according to the manufacturer's protocol, and subsequently enriched using AutoMACS® Pro Separator (Miltenyi). Enriched cells were grown in G-Rex plates as before harvest.

Primary T Cell Functional Assay (Acute)

Target cell line pairs (HLA-A*02(−) and HLA-A*02(+)), expressing either GFP or RFP, were electroporated with CEA mRNA at stated amounts using 4D Nucleofector and cultured as described above, except that 384-well PDL-coated plates (Greiner bio-one, Cat #781091) were used for cell imaging. If needed, identical cell numbers were seeded in parallel in another 384-well plate (Corning, Cat #3570) for cell density determination. On the next day, target cell seeding density was measured by cell-titer glow (Promega, G7570) per manufacturer's instruction. Percentages of CEA CAR-positive and CEA CAR/A*02 blocker double-positive T cells were determined by flow cytometry before co-culture. If needed, untransduced T cells were mixed with CEA CAR-positive pools to match the percentage of positive CEA CAR cells to the double-positive population. Target cells and T cells were co-cultured for up to 48 hours. Whole-well fluorescence signal was monitored on IncuCyte S3 or ImageXpress® Micro Confocal imager (Molecule Device Corporation) with a 4× objective during co-culture, and total fluorescence area or intensity was recorded over time. Reduction of fluorescence signal in CAR or Tmod co-cultures compared to wells without T cells or co-cultured with untransduced T cells allowed comparisons of cytotoxicity of CEA activator and CEA Tmod constructs. CEA expression on target cells was determined using the QIFIKIT as described above.

When mixed target cells were used, normal CEA(+)A*02 (+) target cells with GFP-*renilla* luciferase and tumor CEA (+)A*02(−) target cells engineered with RFP-firefly luciferase were mixed at 1:1 ratios and co-cultured with enriched primary T cells as described above. Cytotoxicity was determined by monitoring GFP and RFP signal loss on IncuCyte S3.

Reversibility Cytotoxicity Assays

Target cell lines were co-cultured with T cells in LymphoneONE™ plus 100 human serum and 1×P/S. Briefly, target cells were plated at 500,000 cells/well in 6-well plates for bulk co-cultures intended for serial-transfer experiments. In 384-well imaging plates, target cells were seeded at 5,000 cells/well and incubated overnight. The next day, T cells were added to co-culture wells at a nominal effector-to-target (E:T) ratio of 3:1 (1,500,000 cells/well in the 6-well format; 15,000 cells/well in the 384-well format). Incubation/imaging was performed on the IncuCyte® S3 platform (Sartorius), with imaging every 2 hours for 48 hours (spanning each round of serial co-culture); 6-well plates were incubated offline at 37° C. At the end of each 48-hour cycle, T cells were separated from target cells and collected from 6-well co-cultures; these T cells were counted and resuspended at a uniform density in fresh media for transfer to (i) a new well of bulk target cells for the next co-culture in the indicated series, and (ii) a new set of imaging wells (384-well format) to collect data for the next co-culture in the series. In the second round, 12-well plates were used for bulk co-cultures containing 750,000 T cells and 250,000 target cells (E:T ratio remained constant throughout the series; imaging plate co-cultures were used throughout the study in the 384-well format at a nominal 15,000:5,000 E:T ratio). The result was a series of co-cultures in which enriched primary T cells were alternately cultured with normal (CEA(+) HLA-A*02(+)) then tumor (CEA(+) HLA-A*02(−)) target cells, or vice versa. Data were presented as specific killing (%), reflecting the percent loss of the target-cell GFP signal in transduced populations compared to donor-matched untransduced T cells.

Xenograft Study

In vivo experiments were conducted by Explora BioLabs under Institutional Animal Care and Use Committee (IACUC)-approved protocols. 5-6 week-old female NSG (NOD.Cg-Prkdc$^{scid}$Il2rg$^{tm1Wjl}$/SzJ), JAX stock No. 005557 mice were purchased from The Jackson Labs. Animals were acclimated to the housing environment for at least 3 days prior to the initiation of the study.

After acclimation to the housing environment, animals were injected with tumor cells, as determined in a pilot study that established the proper cell number. The H508 xenograft model was established using the wildtype or isogenic HLA-A*02(−) cell lines engineered with a firefly luciferase reporter (see above). 2E7 H508 cells in 50% were injected subcutaneously into the flanks of NSG mice. "Normal" cells were injected subcutaneously into the right flank, and tumor cells into the left flank of each mouse. Tumor growth was monitored via caliper measurements. When tumors reach an average size of ~100-200 mm³, animals were randomized into groups and T cells administered via the tail vein. Post T-cell injection, tumor measurements were performed 3 times per week until total tumor burden in mice reaches 2,000 mm³. Bioluminescence quantification was performed on a subset of 5 mice from each cohort of 7. In brief, each mouse received a 100 μl subcutaneous injection of Xeno-Light D-luciferin potassium salt (PerkinElmer 122799) and then were imaged 15 minutes later on their dorsal side using an IVIS® Spectrum In Vivo Imaging System (Perkin Elmer). Animals were monitored for general health via clinical observations and effects on body weight at regular intervals throughout the study.

Blood and serum collected on days=−1, 2, 9, 16, 30 post T cell injection and at termination of the study. Staining for T cells in the blood and spleen was performed after red blood cell lysis on a BD FACSCanto II. Mouse cells were excluded by staining with antibodies to mouse CD45 and Ter 19. Human T cells were stained with antibodies to human CD3, CD4 and CD8. The source of all antibodies is listed in Supplementary Table 23.

TABLE 22 gRNA targeting sequences used for CRISPR/Cas9 generated knockout of CEA and HLA-A

| gRNA | CEA | HLA-A |
|---|---|---|
| 1 | GATCTGACTTTATGACGTGT (SEQ ID NO: 976) | CCTTCACATTCCGTGTCTCC (SEQ ID NO: 977) |
| 2 | N/A | ACAGCGACGCCGCGAGCCAG (SEQ ID NO: 978) |
| 3 | N/A | TTCACATCCGTGTCCCGGCC (SEQ ID NO: 979) |

TABLE 23

Summary of Antibodies and recombinant proteins used in Examples 7-11

| Antibody | Name | Vendor | Cat# |
|---|---|---|---|
| 1 | Brilliant Violet 421 ™ anti-human HLA-A2 Antibody | BioLegend | 343326 |
| 2 | Streptavidin-PE | ThermoFisher Scientific | 12-4317-87 |
| 3 | Protein L | Thermo Scientific | 29997 |
| 4 | Streptavidin-APC | BioLegend | 405243 |
| 5 | F(ab')2-Goat anti-Mouse IgG (H + L) Cross-Adsorbed Secondary Antibody, Alexa Fluor 647 | ThermoFisher Scientific | A-21237 |
| 6 | Brilliant Violet 421 ™ anti-mouse TCR β chain Antibody | BioLegend | 109230 |
| 7 | Purified anti-human HLA-A2 Antibody | BioLegend | 343302 |
| 8 | Human CEACAM-5 Antibody | R&D Systems | MAB41281 |
| 9 | Soluble CEA (sCEA) | R&D Systems | 4128-CM-050 |
| 10 | APC anti-mouse TER-119/Erythroid Cells Antibody | Biolegend | 116212 |
| 11 | APC anti-mouse CD45 Antibody | Biolegend | 103112 |
| 12 | Brilliant Violet 510 ™ anti-human CD3 Antibody | Biolegend | 300448 |
| 13 | Alexa Fluor ® 488 anti-human CD4 Antibody | Biolegend | 317420 |
| 14 | PE anti-human CD8 Antibody | Biolegend | 344706 |
| 15 | PE anti-mouse TCR β chain Antibody | Biolegend | 109208 |

Figure 13:
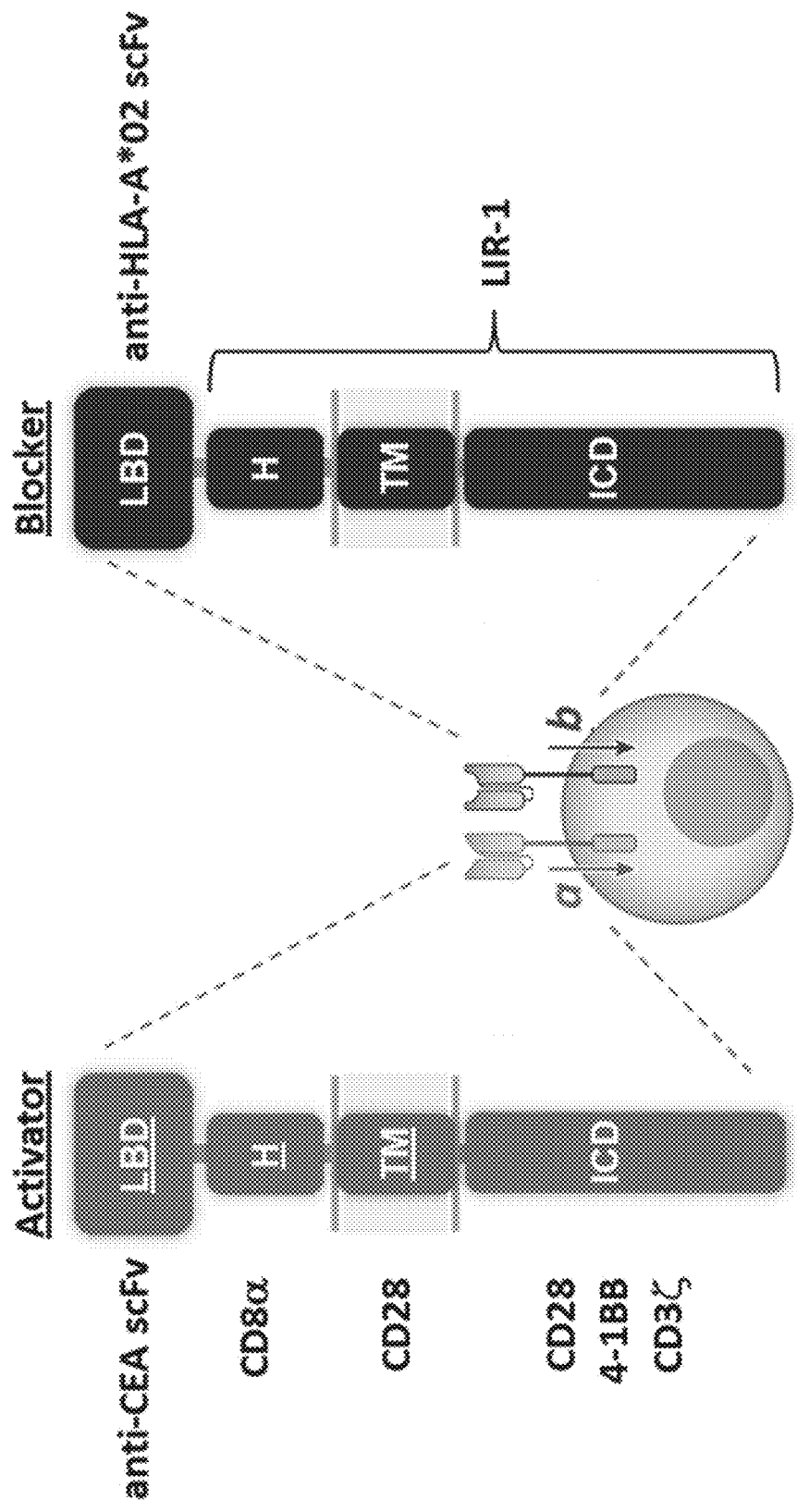
FIG. 13 is a diagram showing the molecular composition of an exemplary dual receptor system of the disclosure, comprising a CEA CAR and an HLA-A*02 scFv LILRB1 inhibitory receptor.

Example 6: Design and Activity of a CEA Chimeric Antigen Receptor and LILRB1 Inhibitory Receptor Pair A humanized scFv based on a mouse mAb that binds an extracellular epitope in the membrane-proximal CEA B3 domain was generated. The original mAb was thought to bind an epitope that is absent from the shed form of the protein, thereby avoiding the risk of receptor inhibition by soluble CEA. The CEA scFv was fused to a generation 3 CAR, which included a CD8α hinge, a CD28 transmembrane domain, and 4-1BB, and CD3ζ intracellular domains (FIG. 13). The sequences are shown in Table 24 below.

Figure 14:
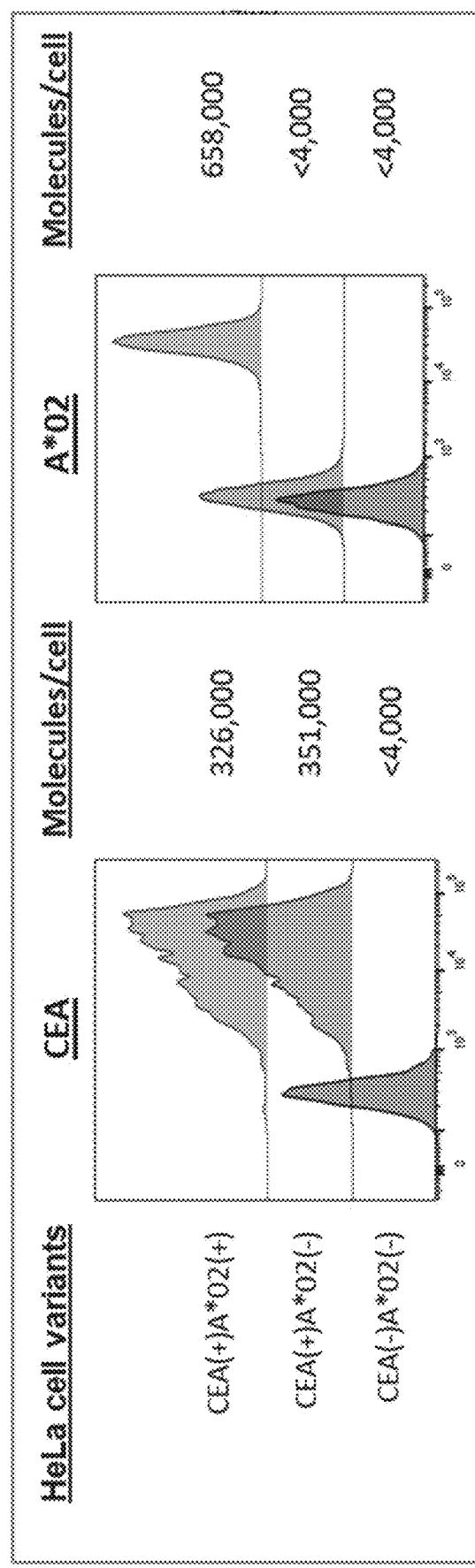
FIG. 14 shows the expression of CEA and HLA-A*02 antigens in HeLa cells. A*02: HLA-A*02.

After confirming activity of the CAR activator alone, the CEA CAR was co-expressed with the HLA-A*02 inhibitory receptor, a construct that contains an HLA-A*02-specific scFv fused to the hinge, transmembrane and signaling domains of the LILRB1 gene product (LIR-1). LIR-1 is a member of the immune inhibitory receptor family and contains 4 ITIMs in its signaling domain. The CAR and LIR-1 inhibitory receptors expressed well on the surface of Jurkat and primary T cells, and both receptors functioned in a largely ligand-dependent fashion using HeLa target cells engineered to express CEA, HLA-A*02 or both (FIGS. 14-17). CEA and HLA-A*02 were stably expressed in HeLa cells, which were stained with labeled mAbs and analyzed by flow cytometry. The surface antigen density of each antigen was determined using QIFIKIT (FIG. 14). Expression and enrichment of both receptors in transfected Jurkat cells and transduced primary T effector cells was confirmed using fluorescence activated flow cytometry (FACS).

Figure 15:
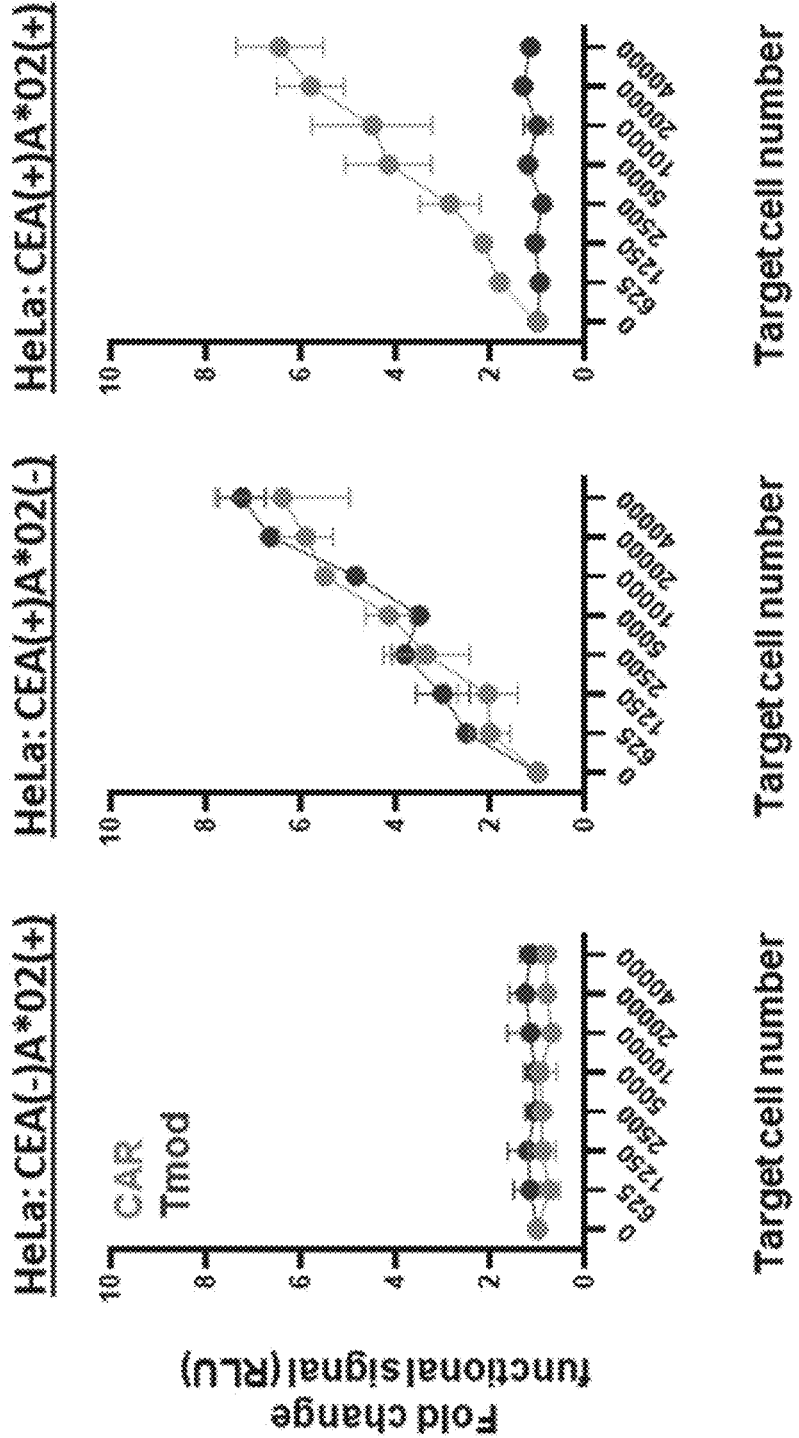
FIG. 15 shows that the CEA activator and HLA-A*02 LILRB1 inhibitory receptor function in Jurkat cells using engineered HeLa cells as targets for cytotoxicity. A*02: HLA-A*02; Tmod: the cells express the CEA CAR and the HLA-A*02 inhibitory receptor; CAR: cells express the CEA CAR only.

Except where noted, a single vector construct with both receptor modules encoded by a single fusion gene containing a cleavable T2A linker and an shRNA expression cassette to reduce β$_2$ microglobulin (B2M) expression was used to transfect Jurkat cells, or transduce primary effector T cells In FIG. 15, the CEA CAR is specifically blocked in Jurkat cells co-cultured with HeLa target cells that express both CEA and HLA-A*02. Jurkat cells that contain an NFAT-luciferase reporter were engineered to stably express activator and blocker from two separate constructs.

Figure 16:
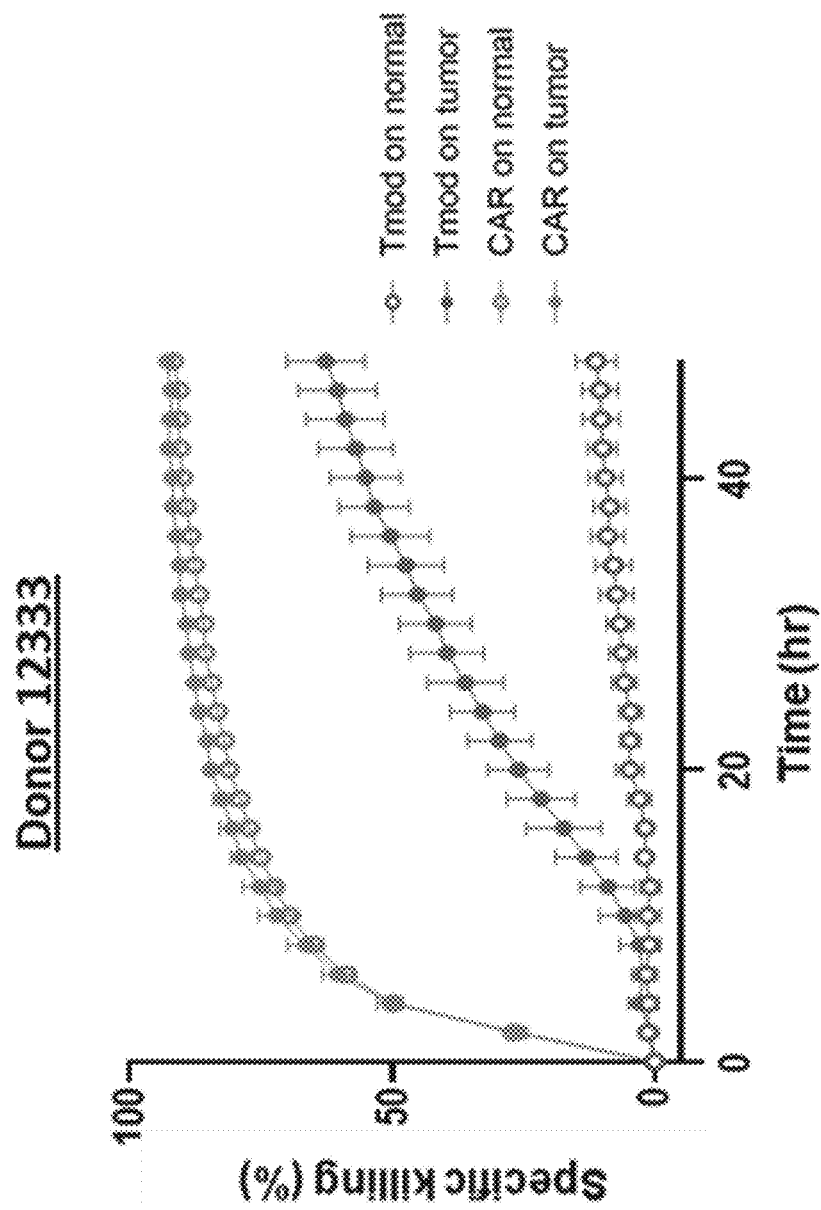
FIG. 16 shows that the CEA activator and HLA-A*02 LILRB1 inhibitory receptor function in donor T cells from a single donor on HeLa cells. Tmod: the cells express the CEA CAR and the HLA-A*02 inhibitory receptor; CAR: cells express the CEA CAR only.
Figure 17:
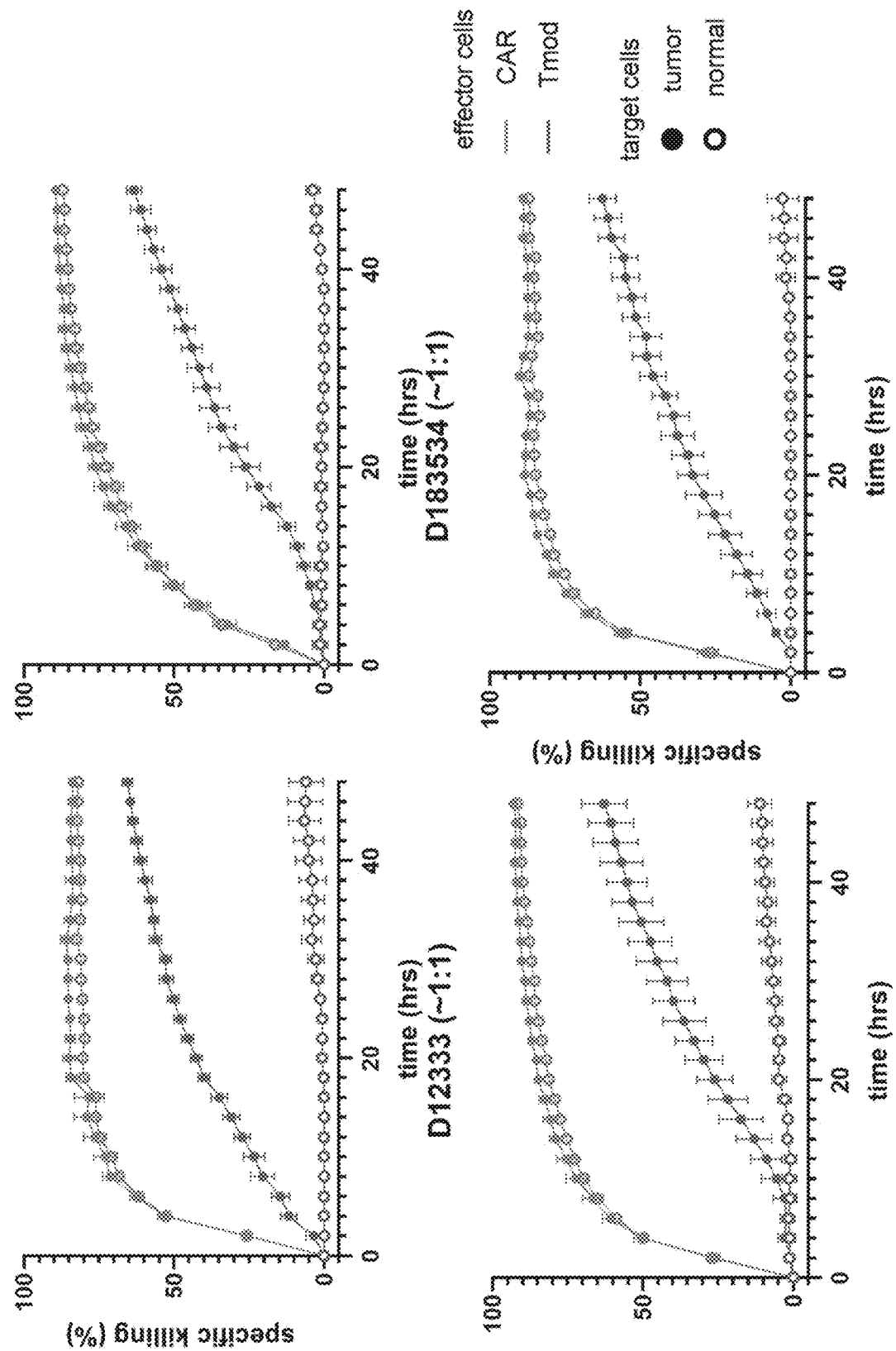
FIG. 17 shows that the CEA activator and HLA-A*02 LILRB1 inhibitory receptor function in T cells from four donors on HeLa cells. Tmod: the cells express the CEA CAR and the HLA-A*02 inhibitory receptor; CAR: cells express the CEA CAR only. Target cells are HeLa cells expressing CEA only or CEA and HLA-A*02.

In FIGS. 16 and 17, cytotoxicity in primary T cells expressing the two receptors was assayed with engineered HeLa cell targets. In FIG. 16, a single lentiviral vector encoding both receptors was used for transduction of HLA-A*02(+) donor T cells, which were enriched for blocker-positive cells prior to assay. One donor (who was HL-A*02 (+)) is shown in FIG. 16, while four donors are shown in FIG. 17.

Results for T cells from additional donors are shown in FIG. 17. Engineered HeLa cells were again used a targets for cytotoxicity, and primary T cells were transduced with a single lentiviral vector encoding both receptors. Enrichment was performed using the blocker ligand (HLAA*02 pMHC) and protein L, prior to assay. The donors were A*02(+), except D183534, who was HLA-A*02(-).

TABLE 24

Sequences of CEA CAR and LILRB1 Inhibitory Receptor

| Name | Protein Sequence | DNA Sequence |
|---|---|---|
| Activator receptor | | |
| CEA CAR-T2A-HLA-A*02 inhibitory Receptor | MDMRVPAQLLGLLL LWLRGARCDVLMTQ TPLSLPVSLGDQAS ISCRSSQSIVHSNG NTYLEWYLQKPGQS PKLLIYKVSNRFSG VPDRFSGSGSGTDF TLKISRVEAEDLGV YYCFQGSHVPRTSG GGTKLEIKGGGSG GGGSGGGGSGGQVQ LQQSGPELVKPGAS VRISCKASGYTFTS YHIHWVKQRPGQGL EWIGWIYPGNVNTE YNEKFKGKATLTAD KSSSTAYMHLSSLT SEDSAVYFCAREEI TYAMDYWGQGTSVT VSSYGSQSSKPYLL THPSDPLELVVSGP SGGPSSPTTGPTST SGPEDQPLTPTGSD PQSGLGRHLGVVIG ILVAVILLLLLLLL LFLILRHRRQGKHW TSTQRKADFQHPAG AVGPEPTDRGLQWR SSPAADAQEENLYA AVKHTQPEDGVEMD TRSPHDEDPQAVTY AEVKHSRPRREMAS PPSPLSGEFLDTKD RQAEEDRQMDTEAA ASEAPQDVTYAQLH SLTLRREATEPPPS QEGPSPAVPSIYAT LAIHGSGEGRGSLL TCGDVEENPGPMDM RVPAQLLGLLLLWL RGARCQVQLVQSGS | ATGGATATGAGAGTGCCTGCCCAGCTGCTCGGACTGCTCCTTC TGTGGTTGAGAGGAGCTCGGTGCGATGTTCTGATGACCCAAAC TCCACTCTCCCTGCCTGTCAGTCTTGGAGATCAAGCCTCCATC TCTTGCAGATCTAGTCAGAGCATTGTACATAGTAATGGAAACA CCTATTTAGAATGGTACCTGCAGAAGCCAGGCCAGTCTCCAAA GCTGCTCATCTACAAAGTTTCCAACCGATTTTCTGGGGTCCCA GACAGATTTAGCGGATCTGGCTCTGGGACCGATTTCACACTCA AGATCAGTAGAGTGGAGGCTGAGGATCTGGGAGTTTATTACTG CTTTCAAGGTTCACATGTTCCTCGGACGTCCGGTGGAGGCACA AAGCTGGAAATCAAGGGAGGTGGCGGCTCTGGAGGCGGAGGTA GCGGAGGTGGAGGCTCTGGTGGCCAGGTCCAGCTGCAGCAGTC TGGACCTGAGCTGGTGAAGCAGGGGCTTCAGTGAGGATATCC TGTAAGGCCTCTGGCTACACCTTTACAAGTTACCATATACATT GGGTGAAGCAGAGGCCTGGACAGGGACTCGAATGGATTGGATG GATTTATCCTGGAAATGTTAATACTGAGTACAATGAGAAGTTC AAGGGCAAGGCCACACTGACTGCAGACAAATCGTCCAGCACAG CCTACATGCACCTCAGCAGCCTGACCTCTGAGGACTCTGCGGT CTATTTCTGTGCCAGAGAGGAGATTACCTATGCTATGGATTAT TGGGGTCAAGGAACCTCAGTCACCGTGTCCTCATACGGCTCAC AGAGCTCCAAACCCTACCTGCTGACTCACCCTAGTGATCCTCT GGAGCTCGTGGTCTCAGGACCGTCTGGAGGCCCAAGCTCTCCG ACAACAGGCCCCACCTCCACATCTGGCCCTGAGGACCAGCCCC TCACACCCACCGGGTCGGATCCTCAGAGTGGTCTGGGAAGACA CCTGGGAGTTGTGATCGGCATCTTGGTGGCCGTCATCCTACTG CTCCTCCTCCTGCTCCTGCTCTTCCTCATCCTCCGACATCGAC GTCAGGGCAAACACTGGACATCGACCCAGAGAAAGGCTGATTT CCAACATCCTGCAGGGGCTGTGGGGCCAGAGCCCACAGACAGA GGCCTGCAGTGGAGGTCCAGCCCAGCTGCCGATGCCCAGGAAG AAAACCTCTATGCTGCCGTGAAGCACACACAGCCTGAGGATGG GGTGGAGATGGATACTCGGAGCCCACACGATGAAGATCCACAG GCAGTGACGTATGCCGAGGTGAAACACTCCAGACCTAGAAGGG AAATGGCCTCTCCTCCTTCCCCACTGTCTGGAGAGTTCCTGGA CACAAAGGACAGACAGGCGGAAGAGGACAGGCAGATGGACACT GAGGCTGCTGCATCTGAAGCTCCTCAGGATGTGACCTACGCCC AGCTGCACAGCTTGACCCTCAGACGGGAGGCAACTGAGCCTCC TCCATCCCAGGAAGGGCCCTCTCCAGCTGTGCCCAGCATCTAC GCCACTCTGGCCATCCACGGATCCGGAGAGGGCAGAGGCAGCC TGCTGACATGTGGCGACGTGGAAGAACCCTGGCCCCATGGA CATGAGGGTCCCCGCTCAGCTCCTGGGGCTCCTGCTACTCTGG CTCCGAGGTGCCAGATGTCAGGTGCAGCTGGTGCAATCTGGGT CTGAGTTGAAGAAGCCTGGGGCCTCAGTGAAGGTTTCCTGCAA |

TABLE 24-continued

Sequences of CEA CAR and LILRB1 Inhibitory Receptor

| Name | Protein Sequence | DNA Sequence |
|---|---|---|
| | ELKKPGASVKVSCK ASGYTFTEFGMNWV RQAPGQGLEWMGWI NTKTGEATYVEEFK GRFVFSLDTSVSTA YLQISSLKAEDTAV YYCARWDFAYYVEA MDYWGQGTTVTVSS GGGGSGGGGSGGGG SGGDIQMTQSPSSL SASVGDRVTITCKA SQNVGTNVAWYQQK PGKAPKLLIYSASY RYSGVPSRFSGSGS GTDFTLTISSLQPE DFATYYCHQYYTYP LFTFGQGTKLEIKT TTPAPRPPTPAPTI ASQPLSLRPEACRP AAGGAVHTRGLDFA CDFWVLVVVGGVLA CYSLLVTVAFIIFW VRSKRSRLLHSDYM NMTPRRPGPTRKHY QPYAPPRDFAAYRS KRGRKKLLYIFKQP FMRPVQTTQEEDGC SCRFPEEEEGGCEL RVKFSRSADAPAYK QGQNQLYNELNLGR REEYDVLDKRRGRD PEMGGKPRRKNPQE GLYNELQKDKMAEA YSEIGMKGERRRGK GHDGLYQGLSTATK DTYDALHMQALPPR (SEQ ID NO: 141) | GGCTTCTGGATACACCTTCACTGAGTTTGGAATGAACTGGGTG CGACAGGCCCCTGGACAAGGGCTTGAGTGGATGGGATGGATAA ACACCAAAACTGGAGAGGCAACATATGTTGAAGAGTTTAAGGG ACGGTTTGTCTTCTCCTTGGACACCTCTGTCAGCACGGCATAT CTGCAGATCAGCAGCCTAAAGGCTGAAGACACTGCCGTGTATT ACTGTGCGAGATGGGACTTCGCTTATTACGTGGAGGCTATGGA CTACTGGGGCCAAGGGACCACGGTGACCGTGTCATCCGGCGGA GGTGGAAGCGGAGGGGGAGGATCTGGCGGCGGAGGAAGCGGAG GCGATATCCAGATGACCCAGTCTCCATCCTCCCTGTCTGCATC TGTGGGAGACAGAGTCACCATCACTTGCAAGGCCAGTCAGAAT GTGGGTACTAATGTTGCCTGGTATCAGCAGAAACCAGGGAAAG CACCTAAGCTCCTGATCTATTCGGCATCCTACCGCTACAGTGG AGTCCCATCAAGGTTCAGTGGCAGTGGATCTGGGACAGATTTC ACTCTCACCATCAGCAGTCTGCAACCTGAAGATTTCGCAACTT ACTACTGTCACCAATATTACACCTATCCTCTATTCACGTTTGG CCAGGGCACCAAGCTCGAGATCAAGACAACGACGCCAGCTCCC CGCCCGCCAACCCCTGCACCTACGATTGCATCACAACCGCTGT CCCTGCGGCCTGAAGCTTGTCGCCCAGCCGCAGGTGGCGCCGT ACATACACGGGGGCTGGATTTTGCCTGTGATTTCTGGGTGCTG GTCGTTGTGGGCGGCGTGCTGGCCTGCTACAGCCTGCTGGTGA CAGTGGCCTTCATCATCTTTTGGGTGAGGAGCAAGCGGAGTCG ACTGCTGCACAGCGACTACATGAACATGACCCCCCGGAGGCCT GGCCCCACCCGGAAGCACTACCAGCCCTACGCCCTCCCAGGG ATTTCGCCGCCTACCGGAGCAAACGGGGCAGAAAGAAACTCCT GTATATATTCAAACAACCATTTATGAGGCCAGTACAAACTACT CAAGAGGAAGATGGCTGTAGCTGCCGATTTCCAGAAGAAGAAG AAGGAGGATGTGAACTGAGAGTGAAGTTCAGCAGGAGCGCAGA CGCCCCCGCGTACAAGCAGGGCCAGAACCAGCTCTATAACGAG CTCAATCTAGGACGAAGAGAGGAGTACGATGTTTTGGACAAGC GTAGAGGCCGGGACCCTGAGATGGGGGGAAAGCCGAGAAGGAA GAACCCTCAGGAAGGCCTGTACAATGAACTGCAGAAAGATAAG ATGGCGGAGGCCTACAGTGAGATTGGGATGAAAGGCGAGCGCC GGAGGGGCAAGGGGCACGATGGCCTTTACCAGGGACTCAGTAC AGCCACCAAGGACACCTACGACGCCCTTCACATGCAGGCCCTG CCCCCTCGCTAA (SEQ ID NO: 142) |
| CEA CAR | MDMRVPAQLLGLLL LWLRGARCQVQLVQ SGSELKKPGASVKV SCKASGYTFTEFGM NWVRQAPGQGLEWM GWINTKTGEATYVE EFKGRFVFSLDTSV STAYLQISSLKAED TAVYYCARWDFAYY VEAMDYWGQGTTVT VSSGGGGSGGGGSG GGGSGGDIQMTQSP SSLSASVGDRVTIT CKASQNVGTNVAWY QQKPGKAPKLLIYS ASYRYSGVPSRFSG SGSGTDFTLTISSL QPEDFATYYCHQYY TYPLFTFGQGTKLE IKTTTPAPRPPTPA PTIASQPLSLRPEA CRPAAGGAVHTRGL DFACDFWVLVVVGG VLACYSLLVTVAFI IFWVRSKRSRLLHS DYMNMTPRRPGPTR KHYQPYAPPRDFAA YRSKRGRKKLLYIF KQPFMRPVQTTQEE DGCSCRFPEEEEGG CELRVKFSRSADAP AYKQGQNQLYNELN LGRREEYDVLDKRR GRDPEMGGKPRRKN PQEGLYNELQKDKM AEAYSEIGMKGERR | ATGGACATGAGGGTCCCCGCTCAGCTCCTGGGGCTCCTGCTAC TCTGGCTCCGAGGTGCCAGATGTCAGGTGCAGCTGGTGCAATC TGGGTCTGAGTTGAAGAAGCCTGGGGCCTCAGTGAAGGTTTCC TGCAAGGCTTCTGGATACACCTTCACTGAGTTTGGAATGAACT GGGTGCGACAGGCCCCTGGACAAGGGCTTGAGTGGATGGGATG GATAAACACCAAAACTGGAGAGGCAACATATGTTGAAGAGTTT AAGGGACGGTTTGTCTTCTCCTTGGACACCTCTGTCAGCACGG CATATCTGCAGATCAGCAGCCTAAAGGCTGAAGACACTGCCGT GTATTACTGTGCGAGATGGGACTTCGCTTATTACGTGGAGGCT ATGGACTACTGGGGCCAAGGGACCACGGTGACCGTGTCATCCG GCGGAGGTGGAAGCGGAGGGGGAGGATCTGGCGGCGGAGGAAG CGGAGGCGATATCCAGATGACCCAGTCTCCATCCTCCCTGTCT GCATCTGTGGGAGACAGAGTCACCATCACTTGCAAGGCCAGTC AGAATGTGGGTACTAATGTTGCCTGGTATCAGCAGAAACCAGG GAAAGCACCTAAGCTCCTGATCTATTCGGCATCCTACCGCTAC AGTGGAGTCCCATCAAGGTTCAGTGGCAGTGGATCTGGGACAG ATTTCACTCTCACCATCAGCAGTCTGCAACCTGAAGATTTCGC AACTTACTACTGTCACCAATATTACACCTATCCTCTATTCACG TTTGGCCAGGGCACCAAGCTCGAGATCAAGACAACGACGCCAG CTCCCCGCCCGCCAACCCCTGCACCTACGATTGCATCACAACC GCTGTCCCTGCGGCCTGAAGCTTGTCGCCCAGCCGCAGGTGGC GCCGTACATACACGGGGGCTGGATTTTGCCTGTGATTTCTGGG TGCTGGTCGTTGTGGGCGGCGTGCTGGCCTGCTACAGCCTGCT GGTGACAGTGGCCTTCATCATCTTTTGGGTGAGGAGCAAGCGG AGTCGACTGCTGCACAGCGACTACATGAACATGACCCCCCGGA GGCCTGGCCCCACCCGGAAGCACTACCAGCCCTACGCCCTCC CAGGGATTTCGCCGCCTACCGGAGCAAACGGGGCAGAAAGAAA CTCCTGTATATATTCAAACAACCATTTATGAGGCCAGTACAAA CTACTCAAGAGGAAGATGGCTGTAGCTGCCGATTTCCAGAAGA AGAAGAAGGAGGATGTGAACTGAGAGTGAAGTTCAGCAGGAGC GCAGACGCCCCCGCGTACAAGCAGGGCCAGAACCAGCTCTATA ACGAGCTCAATCTAGGACGAAGAGAGGAGTACGATGTTTTGGA CAAGCGTAGAGGCCGGGACCCTGAGATGGGGGAAAGCCGAGA AGGAAGAACCCTCAGGAAGGCCTGTACAATGAACTGCAGAAAG ATAAGATGGCGGAGGCCTACAGTGAGATTGGGATGAAAGGCGA GCGCCGGAGGGGCAAGGGGCACGATGGCCTTTACCAGGGACTC |

TABLE 24-continued

Sequences of CEA CAR and LILRB1 Inhibitory Receptor

| Name | Protein Sequence | DNA Sequence |
|---|---|---|
| | RGKGHDGLYQGLST ATKDTYDALHMQAL PPR (SEQ ID NO: 52) | AGTACAGCCACCAAGGACACCTACGACGCCCTTCACATGCAGG CCCTGCCCCTCGC (SEQ ID NO: 143) |
| CEA CAR VH region | QVQLVQSGSELKKP GASVKVSCKASGYT FTEFGMNWVRQAPG QGLEWMGWINTKTG EATYVEEFKGRFVF SLDTSVSTAYLQIS SLKAEDTAVYYCAR WDFAYYVEAMDYWG QGTTVTVSS (SEQ ID NO: 144) | CAGGTGCAGCTGGTGCAATCTGGGTCTGAGTTGAAGAAGCCTG GGGCCTCAGTGAAGGTTTCCTGCAAGGCTTCTGGATACACCTT CACTGAGTTTGGAATGAACTGGGTGCGACAGGCCCCTGGACAA GGGCTTGAGTGGATGGGATGGATAAACACCAAAACTGGAGAGG CAACATATGTTGAAGAGTTTAAGGGACGGTTTGTCTTCTCCTT GGACACCTCTGTCAGCACGGCATATCTGCAGATCAGCAGCCTA AAGGCTGAAGACACTGCCGTGTATTACTGTGCGAGATGGGACT TCGCTTATTACGTGGAGGCTATGGACTACTGGGGCCAAGGGAC CACGGTGACCGTGTCATCC (SEQ ID NO: 145) |
| Linker | GGGGSGGGGSGGGG SGG (SEQ ID NO: 146) | GGCGGAGGTGGAAGCGGAGGGGGAGGATCTGGCGGCGGAGGAA GCGGAGGC (SEQ ID NO: 147) |
| CEA CAR VL region | DIQMTQSPSSLSAS VGDRVTITCKASQN VGTNVAWYQQKPGK APKLLIYSASYRYS GVPSRFSGSGSGTD FTLTISSLQPEDFA TYYCHQYYTYPLFT FGQGTKLEIK (SEQ ID NO: 148) | GATATCCAGATGACCCAGTCTCCATCCTCCCTGTCTGCATCTG TGGGAGACAGAGTCACCATCACTTGCAAGGCCAGTCAGAATGT GGGTACTAATGTTGCCTGGTATCAGCAGAAACCAGGGAAAGCA CCTAAGCTCCTGATCTATTCGGCATCCTACCGCTACAGTGGAG TCCCATCAAGGTTCAGTGGCAGTGGATCTGGGACAGATTTCAC TCTCACCATCAGCAGTCTGCAACCTGAAGATTTCGCAACTTAC TACTGTCACCAATATTACACCTATCCTCTATTCACGTTTGGCC AGGGCACCAAGCTCGAGATCAAG (SEQ ID NO: 149) |
| CDR-H1 | EFGMN (SEQ ID NO: 55) | GAGTTTGGAATGAAC (SEQ ID NO: 150) |
| CDR-H2 | WINTKTGEATYVEE FKG (SEQ ID NO: 56) | TGGATAAACACCAAAACTGGAGAGGCAACATATGTTGAAGAGT TTAAGGGA (SEQ ID NO: 151) |
| CDR-H3 | WDFAYYVEAMDY (SEQ ID NO: 57) | TGGGACTTCGCTTATTACGTGGAGGCTATGGACTAC (SEQ ID NO: 152) |
| CDR-L1 | KASQNVGTNVA (SEQ ID NO: 59) | AAGGCCAGTCAGAATGTGGGTACTAATGTTGCC (SEQ ID NO: 153) |
| CDR-L2 | SASYRYS (SEQ ID NO: 61 | TCGGCATCCTACCGCTACAGT (SEQ ID NO: 154) |
| CDR-L3 | HQYYTYPLFT (SEQ ID NO: 63 | CACCAATATTACACCTATCCTCTATTCACG (SEQ ID NO: 155) |
| CD8α hinge | TTTPAPRPPTPAPT IASQPLSLRPEACR PAAGGAVHTRGLDF ACD (SEQ ID NO: 71) | ACAACGACGCCAGCTCCCCGCCCGCCAACCCCTGCACCTACGA TTGCATCACAACCGCTGTCCCTGCGCCCTGAAGCTTGTCGCCC AGCCGCAGGTGGCGCCGTACATACACGGGGCTGGATTTTGCC TGTGAT (SEQ ID NO: 156) |
| CD28 trans-mem-brane domain | FWVLVVVGGVLACY SLLVTVAFIIFWV (SEQ ID NO: 75) | TTCTGGGTGCTGGTCGTTGTGGGCGGCGTGCTGGCCTGCTACA GCCTGCTGGTGACAGTGGCCTTCATCATCTTTTGGGTG (SEQ ID NO: 157) |
| CD28-41BB-CD3ζ intracel-lular domain | RSKRSRLLHSDYMN MTPRRPGPTRKHYQ PYAPPRDFAAYRSK RGRKKLLYIFKQPF MRPVQTTQEEDGCS CRFPEEEEGGCELR VKFSRSADAPAYKQ GQNQLYNELNLGRR EEYDVLDKRRGRDP EMGGKPRRKNPQEG LYNELQKDKMAEAY SEIGMKGERRRGKG | AGGAGCAAGCGGAGTCGACTGCTGCACAGCGACTACATGAACA TGACCCCCCGGAGGCCTGGCCCCACCCGGAAGCACTACCAGCC CTACGCCCCTCCCAGGGATTTCGCCGCCTACCGGAGCAAACGG GGCAGAAAGAAACTTCTGTATATATTCAAACAACCATTTATGA GGCCAGTACAAACTACTCAAGAGGAAGATGGCTGTAGCTGCCG ATTTCCAGAAGAAGAAGAAGGAGGATGTGAACTGAGAGTGAAG TTCAGCAGGAGCGCCGACGCCCCCGCGTACAAGCAGGGCCAGA ACCAGCTCTATAACGAGCTCAATCTAGGACGAAGAGAGGAGTA CGATGTTTTGGACAAGCGTAGAGGCCGGGACCCTGAGATGGGG GGAAAGCCGAGAAGGAAGAACCCTCAGGAAGGCCTGTACAATG AACTGCAGAAAGATAAGATGGCGGAGGCCTACAGTGAGATTGG GATGAAAGGCGAGCGCCGGAGGGGCAAGGGGCACGATGGCCTT |

TABLE 24-continued

Sequences of CEA CAR and LILRB1 Inhibitory Receptor

| Name | Protein Sequence | DNA Sequence |
|---|---|---|
| | HDGLYQGLSTATKD TYDALHMQALPPR (SEQ ID NO: 158) | TACCAGGGACTCAGTACAGCCACCAAGGACACCTACGACGCCC TTCACATGCAGGCCCTGCCCCCTCGC (SEQ ID NO: 159) |
| CD28 co-stimulatory domain | RSKRSRLLHSDYMN MTPRRPGPTRKHYQ PYAPPRDFAAYRS (SEQ ID NO: 83) | AGGAGCAAGCGGAGTCGACTGCTGCACAGCGACTACATGAACA TGACCCCCCGGAGGCCTGGCCCCACCCGGAAGCACTACCAGCC CTACGCCCCTCCCAGGGATTTCGCCGCCTACCGGAGC (SEQ ID NO: 160) |
| 4-1BB | KRGRKKLLYIFKQP FMRPVQTTQEEDGC SCRFPEEEEGGCEL (SEQ ID NO: 161) | AAACGGGGCAGAAAGAAACTCCTGTATATATTCAAACAACCAT TTATGAGGCCAGTACAAACTACTCAAGAGGAAGATGGCTGTAG CTGCCGATTTCCAGAAGAAGAAGGAGGATGTGAACTG (SEQ ID NO: 162) |
| CD3ζ | RVKFSRSADAPAYK QGQNQLYNELNLGR REEYDVLDKRRGRD PEMGGKPRRKNPQE GLYNELQKDKMAEA YSEIGMKGERRRGK GHDGLYQGLSTATK DTYDALHMQALPPR (SEQ ID NO: 79) | AGAGTGAAGTTCAGCAGGAGCGCAGACGCCCCCGCGTACAAGC AGGGCCAGAACCAGCTCTATAACGAGCTCAATCTAGGACGAAG AGAGGAGTACGATGTTTTGGACAAGCGTAGAGGCCGGGACCCT GAGATGGGGGGAAAGCCGAGAAGGAAGAACCCTCAGGAAGGCC TGTACAATGAACTGCAGAAAGATAAGATGGCCGAGGCCTACAG TGAGATTGGGATGAAAGGCGAGCGCCGGAGGGGCAAGGGGCAC GATGGCCTTTACCAGGGACTCAGTACAGCCACCAAGGACACCT ACGACGCCCTTCACATGCAGGCCCTGCCCCCTCGC (SEQ ID NO: 163) |

Inhibitory Receptor

| | | |
|---|---|---|
| anti-HLA-A*02 scFv-LILRB1 hinge, TM and ICD | MDMRVPAQLLGLLL LWLRGARCDVLMTQ TPLSLPVSLGDQAS ISCRSSQSIVHSNG NTYLEWYLQKPGQS PKLLIYKVSNRFSG VPDRFSGSGSGTDF TLKISRVEAEDLGV YYCFQGSHVPRTSG GGTKLEIKGGGGSG GGGSGGGGSGGGVQ LQQSGPELVKPGAS VRISCKASGYTFTS YHIHWVKQRPGQGL EWIGWIYPGNVNTE YNEKFKGKATLTAD KSSSTAYMHLSSLT SEDSAVYFCAREEI TYAMDYWGQGTSVT VSSYGSQSSKPYLL THPSDPLELVVSGP SGGPSSPTTGPTST SGPEDQPLTPTGSD PQSGLGRHLGVVIG ILVAVILLLLLLL LFLILRHRRQGKHW TSTQRKADFQHPAG AVGPEPTDRGLQWR SSPAADAQEENLYA AVKHTQPEDGVEMD TRSPHDEDPQAVTY AEVKHSRPRREMAS PPSPLSGEFLDTKD RQAEEDRQMDTEAA ASEAPQDVTYAQLH SLTLRREATEPPPS QEGPSPAVPSIYAT LATH (SEQ ID NO: 164) | ATGGATATGAGAGTGCCTGCCCAGCTGCTCGGACTGCTCCTTC TGTGGTTGAGAGGAGCTCGGTGCGATGTTCTGATGACCCAAAC TCCACTCTCCCTGCCTGTCAGTCTTGGAGATCAAGCCTCCATC TCTTGCAGATCTAGTCAGAGCATTGTACATAGTAATGGAAACA CCTATTTAGAATGGTACCTGCAGAAGCCAGGCCAGTCTCCAAA GCTGCTCATCTACAAAGTTTCCAACCGATTTTCTGGGGTCCCA GACAGATTTAGCGGATCTGGCTCTGGGACCGATTTCACACTCA AGATCAGTAGAGTGGAGGCTGAGGATCTGGGAGTTTATTACTG CTTTCAAGGTTCACATGTTCCTCGGACGTCCGGTGGAGGCACA AAGCTGGAAATCAAGGGAGGTGGCGGCTCTGGAGGCGGAGGTA GCGGAGGTGGAGGCTCTGGTGGCAGGTCCAGCTGCAGCAGTC TGGACCTGAGCTGGTGAAGCCAGGGGCTTCAGTGAGGATATCC TGTAAGGCCTCTGGCTACACCTTTACAAGTTACCATATACATT GGGTGAAGCAGAGGCCTGGACAGGGACTCGAATGGATTGGATG GATTTATCCTGGAAATGTTAATACTGAGTACAATGAGAAGTTC AAGGGCAAGGCCACACTGACTGCAGACAAATCGTCCAGCACAG CCTACATGCACCTCAGCAGCCTGACCTCTGAGGACTCTGCGGT CTATTTCTGTGCCAGAGAGGAGATTACCTATGCTATGGATTAT TGGGGTCAAGGAACCTCAGTCACCGTGTCCTCATACGGCTCAC AGAGCTCCAAACCCTACCTGCTGACTCACCCTAGTGATCCTCT GGAGCTCGTGGTCTCAGGACCGTCTGGAGGCCCAAGCTCTCCG ACAACAGGCCCCACCTCCACATCTGGCCCTGAGGACCAGCCCC TCACACCCACCGGGTCGGATCCTCAGAGTGGTCTGGGAAGACA CCTGGGAGTTGTGATCGGCATCTTGGTGGCCGTCATCCTACTG CTCCTCCTCCTGCTCCTGCTCTTCCTCATCCTCCGACATCGAC GTCAGGGCAAACACTGGACATCGACCCAGAGAAAGGCTGATTT CCAACATCCTGCAGGGGCTGTGGGCCAGAGCCACAGACAGA GGCCTGCAGTGGAGGTCCAGCCCAGCTGCCGATGCCCAGGAAG AAAACCTCTATGCTGCCGTGAAGCACACACAGCCTGAGGATGG GGTGGAGATGGATACTCGGAGCCCACACGATGAAGATCCACAG GCAGTGACGTATGCCGAGGTGAAACACTCCAGACCTAGAAGGG AAATGGCCTCTCCTCCTTCCCCACTGTCTGGAGAGTTCCTGGA CACAAAGGACAGACAGGCGGAAGAGGACAGGCAGATGGACACT GAGGCTGCTGCATCTGAAGCTCCTCAGGATGTGACCTACGCCC AGCTGCACAGCTTGACCCTCAGACGGGAGGCAACTGAGCCTCC TCCATCCCAGGAAGGGCCCTCTCCAGCTGTGCCCAGCATCTAC GCCACTCTGGCCATCCAC (SEQ ID NO: 165) |
| VL | DVLMTQTPLSLPVS LGDQASISCRSSQS IVHSNGNTYLEWYL QKPGQSPKLLIYKV SNRFSGVPDRFSGS GSGTDFTLKISRVE | GATGTTCTGATGACCCAAACTCCACTCTCCCTGCCTGTCAGTC TTGGAGATCAAGCCTCCATCTCTTGCAGATCTAGTCAGAGCAT TGTACATAGTAATGGAAACACCTATTTAGAATGGTACCTGCAG AAGCCAGGCCAGTCTCCAAAGCTGCTCATCTACAAAGTTTCCA ACCGATTTTCTGGGGTCCCAGACAGATTTAGCGGATCTGGCTC TGGGACCGATTTCACACTCAAGATCAGTAGAGTGGAGGCTGAG |

TABLE 24-continued

Sequences of CEA CAR and LILRB1 Inhibitory Receptor

| Name | Protein Sequence | DNA Sequence |
|---|---|---|
| | AEDLGVYYCFQGSH VPRTSGGGTKLEIK (SEQ ID NO: 166) | GATCTGGGAGTTTATTACTGCTTTCAAGGTTCACATGTTCCTC GGACGTCCGGTGGAGGCACAAAGCTGGAAATCAAG (SEQ ID NO: 167) |
| linker | GGGGSGGGGSGGGG SGG (SEQ ID NO: 146) | GGAGGTGGCGGCTCTGGAGGCGGAGGTAGCGGAGGTGGAGGCT CTGGTGGC (SEQ ID NO: 980) |
| VH | QVQLQQSGPELVKP GASVRISCKASGYT FTSYHIHWVKQRPG QGLEWIGWIYPGNV NTEYNEKFKGKATL TADKSSSTAYMHLS SLTSEDSAVYFCAR EEITYAMDYWGQGT SVTVSS (SEQ ID NO: 981) | CAGGTCCAGCTGCAGCAGTCTGGACCTGAGCTGGTGAAGCCAG GGGCTTCAGTGAGGATATCCTGTAAGGCCTCTGGCTACACCTT TACAAGTTACCATATACATTGGGTGAAGCAGAGGCCTGGACAG GGACTCGAATGGATTGGATGGATTTATCCTGGAAATGTTAATA CTGAGTACAATGAGAAGTTCAAGGGCAAGGCCACACTGACTGC AGACAAATCGTCCAGCACAGCCTACATGCACCTCAGCAGCCTG ACCTCTGAGGACTCTGCGGTCTATTTCTGTGCCAGAGAGGAGA TTACCTATGCTATGGATTATTGGGGTCAAGGAACCTCAGTCAC CGTGTCCTCA (SEQ ID NO: 982) |
| CDR-L1 | RSSQSIVHSNGNTY LE (SEQ ID NO: 103) | AGATCTAGTCAGAGCATTGTACATAGTAATGGAAACACCTATT TAGAA (SEQ ID NO: 169) |
| CDR-L2 | KVSNRFSGVPDR (SEQ ID NO: 104) | AAAGTTTCCAACCGATTTTCTGGGGTCCCAGACAGA (SEQ ID NO: 170) |
| CDR-L3 | FQGSHVPRT (SEQ ID NO: 105) | TTTCAAGGTTCACATGTTCCTCGGACG (SEQ ID NO: 171) |
| CDR-H1 | ASGYTFTSYHIH (SEQ ID NO: 106) | GCCTCTGGCTACACCTTTACAAGTTACCATATACAT (SEQ ID NO: 172) |
| CDR-H2 | WIYPGNVNTEYNEK FKGK (SEQ ID NO: 107) | TGGATTTATCCTGGAAATGTTAATACTGAGTACAATGAGAAGT TCAAGGGCAAG (SEQ ID NO: 173) |
| CDR-H3 | EEITYAMDY (SEQ ID NO: 108) | GAGGAGATTACCTATGCTATGGATTAT (SEQ ID NO: 174) |
| LILR1B hinge, TM and ICD | YGSQSSKPYLLTHP SDPLELVVSGPSGG PSSPTTGPTSTSGP EDQPLTPTGSDPQS GLGRHLGVVIGILV AVILLLLLLLLLFL ILRHRRQGKHWTST QRKADFQHPAGAVG PEPTDRGLQWRSSP AADAQEENLYAAVK HTQPEDGVEMDTRS PHDEDPQAVTYAEV KHSRPRREMASPPS PLSGEFLDTKDRQA EEDRQMDTEAAASE APQDVTYAQLHSLT LRREATEPPPSQEG PSPAVPSIYATLAI H (SEQ ID NO: 132) | TACGGCTCACAGAGCTCCAAACCCTACCTGCTGACTCACCCTA GTGATCCTCTGGAGCTCGTGGTCTCAGGACCGTCTGGAGGCCC AAGCTCTCCGACAACAGGCCCCACCTCCACATCTGGCCCTGAG GACCAGCCCCTCACACCCACCGGGTCGGATCCTCAGAGTGGTC TGGGAAGACACCTGGGAGTTGTGATCGGCATCTTGGTGGCCGT CATCCTACTGCTCCTCCTCCTGCTCCTGCTCTTCCTCATCCTC CGACATCGACGTCAGGGCAAACACTGGACATCGACCCAGAGAA AGGCTGATTTCCAACATCCTGCAGGGGCTGTGGGGCCAGAGCC CACAGACAGAGGCCTGCAGTGGAGGTCCAGCCCAGCTGCCGAT GCCCAGGAAGAAAACCTCTATGCTGCCGTGAAGCACACACAGC CTGAGGATGGGGTGGAGATGGATACTCGGAGCCCACACGATGA AGATCCACAGGCAGTGACGTATGCCGAGGTGAAACACTCCAGA CCTAGAAGGGAAATGGCCTCTCCTCCTTCCCCACTGTCTGGAG AGTTCCTGGACACAAAGGACAGACAGGCGGAAGAGGACAGGCA GATGGACACTGAGGCTGCTGCATCTGAAGCTCCTCAGGATGTG ACCTACGCCCAGCTGCACAGCTTGACCCTCAGACGGGAGGCAA CTGAGCCTCCTCCATCCCAGGAAGGGCCCTCTCCAGCTGTGCC CAGCATCTACGCCACTCTGGCCATCCAC (SEQ ID NO: 175) |
| LILRB1 hinge | YGSQSSKPYLLTHP SDPLELVVSGPSGG PSSPTTGPTSTSGP EDQPLTPTGSDPQS GLGRHLG (SEQ ID NO: 134) | TACGGCTCACAGAGCTCCAAACCCTACCTGCTGACTCACCCTA GTGATCCTCTGGAGCTCGTGGTCTCAGGACCGTCTGGAGGCCC AAGCTCTCCGACAACAGGCCCCACCTCCACATCTGGCCCTGAG GACCAGCCCCTCACACCCACCGGGTCGGATCCTCAGAGTGGTC TGGGAAGACACCTGGGA (SEQ ID NO: 176) |
| LILRB1 TM | VVIGILVAVILLLL LLLLLFLIL (SEQ ID NO: 135) | GTTGTGATCGGCATCTTGGTGGCCGTCATCCTACTGCTCCTCC TCCTGCTCCTGCTCTTCCTCATCCTC (SEQ ID NO: 177) |

TABLE 24-continued

Sequences of CEA CAR and LILRB1 Inhibitory Receptor

| Name | Protein Sequence | DNA Sequence |
|---|---|---|
| LILRB1 | ICDRHRRQGKHWTSTQR KADFQHPAGAVGPE PTDRGLQWRSSPAA DAQEENLYAAVKHT QPEDGVEMDTRSPH DEDPQAVTYAEVKH SRPRREMASPPSPL SGEFLDTKDRQAEE DRQMDTEAAASEAP QDVTYAQLHSLTLR REATEPPPSQEGPS PAVPSIYATLAIH (SEQ ID NO: 131) | CGACATCGACGTCAGGGCAAACACTGGACATCGACCCAGAGAA AGGCTGATTTCCAACATCCTGCAGGGGCTGTGGGGCCAGAGCC CACAGACAGAGGCCTGCAGTGGAGGTCCAGCCCAGCTGCCGAT GCCCAGGAAGAAAACCTCTATGCTGCCGTGAAGCACACACAGC CTGAGGATGGGGTGGAGATGGATACTCGGAGCCCACACGATGA AGATCCACAGGCAGTGACGTATGCCGAGGTGAAACACTCCAGA CCTAGAAGGGAAATGGCCTCTCCTCCTTCCCCACTGTCTGGAG AGTTCCTGGACACAAAGGACAGACAGGCGGAAGAGGACAGGCA GATGGACACTGAGGCTGCTGCATCTGAAGCTCCTCAGGATGTG ACCTACGCCCAGCTGCACAGCTTGACCCTCAGACGGGAGGCAA CTGAGCCTCCTCCATCCCAGGAAGGGCCCTCTCCAGCTGTGCC CAGCATCTACGCCACTCTGGCCATCCAC (SEQ ID NO: 178) | shRNA

| B2M shRNA | Not Relevant | GCACTCAAAGCTTGTTAAGATCGAAATCTTAACAAGCTTTGAG TGC (SEQ ID NO: 179) |
|---|---|---|

Example 7: Sensitivity and Selectivity of a CEA CAR and LILRB1 Inhibitory Receptor Pair The $EC_{50}$ of the CEA activator and $IC_{50}$ of the HLA-A*02 LILRB1 blocker receptor were quantified. These values can be compared with target antigen expression values of human tumor and normal tissues.

Figure 19:
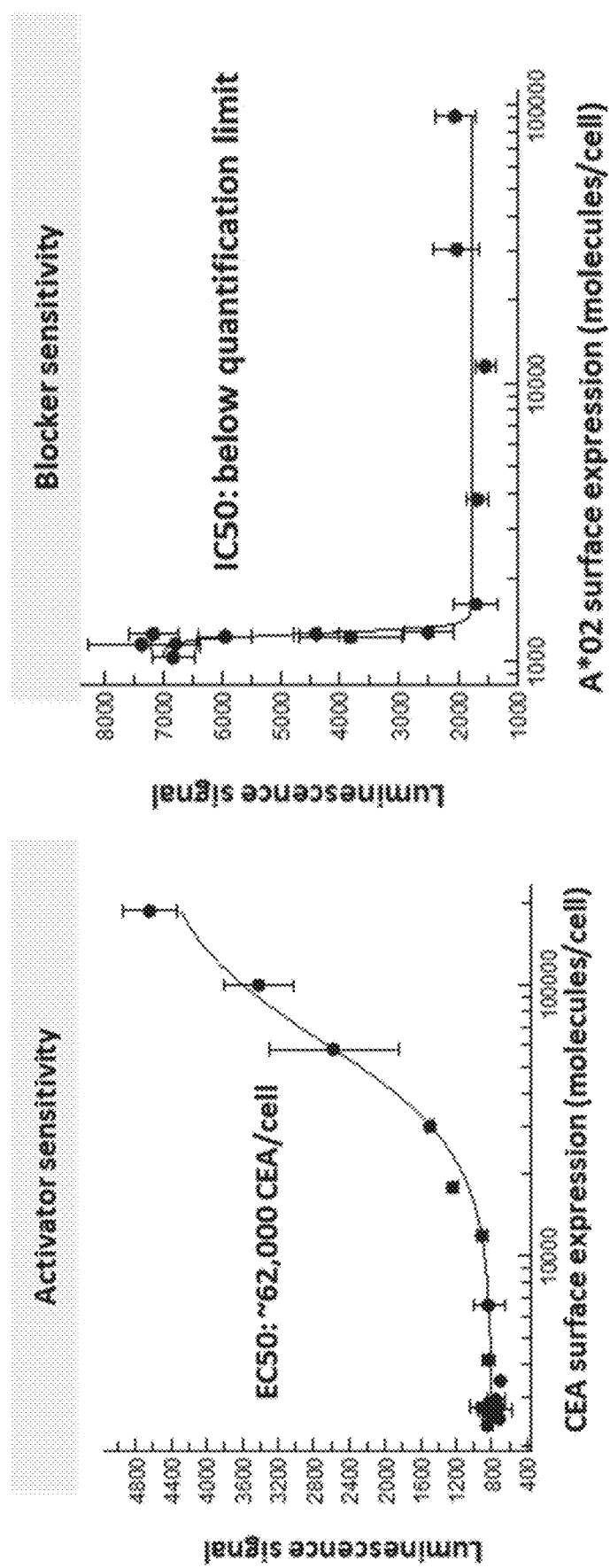
FIG. 19 shows CEA CAR activator and HLA-A*02 LILRB1 blocker sensitivity measured as a function of the number of CEA surface molecules in HeLa cells using Jurkat effector cells with stably expressed CEA activator and HLA-A*02 blocker receptors.
Figure 20:
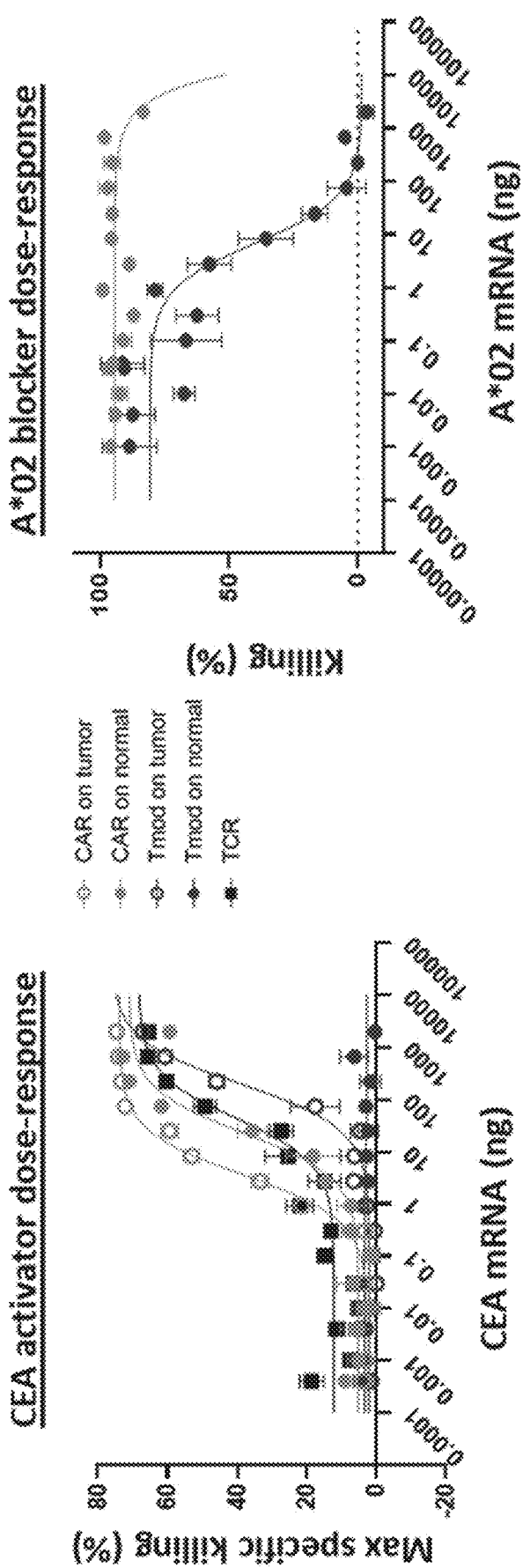
FIG. 20 shows sensitivity of activator and blocker of primary T cells expressing CEA CAR Tmod (both the CEA CAR and HLA-A*02 and LILRB1 inhibitory receptors), CAR-only, and CEA TCR. The dose response curve for the activator (right) is shown for the CEA CAR, CEA CAR with the HLA-A*02 blocker (Tmod), and the CEA TCR, while the dose response curve for the inhibitory receptor (blocker) is only for the CEA CAR and the CEA CAR with the HLA-A*02 blocker (Tmod). A*02: HLA-A*02.

Synthetic mRNA was to control surface levels of CEA and HLA-A*02 antigens on HeLa target cells and variants, coupled with functional measurements in Jurkat cells (FIGS. 18-19). A similar experiments using primary T cell cytotoxicity assays was conducted, and included an HLA-A*02-restricted CEA TCR for comparison (FIG. 20). The CEA TCR is described in CEA TCR is described in Parkhurst et al. (2009). Clin Cancer Res 15, 169-180. This TCR was shown by Rosenberg and colleagues to be active in the clinic, but terminated because of colitis (Parkhurst et al., 2011, Mol Ther 19, 620-626).

In FIG. 20, the HLA-A*02(+) donor T cells with both receptors were co-cultured with HeLa target cells. For EC50 estimation, different amounts of CEA mRNA were transfected into CEA(-) HLA-A*02(-) or CEA(-) HLA-A*02(+) HeLa cells before co-culture. To create matched surrogate "normal" cells, 1 μg A*02 mRNA were co-transfected. Maximum killing (Kmax; normalized to total target cell number) was plotted against CEA mRNA amount. The EC50s calculated as mRNA amount and molecules/cell are listed in Table 25. The TCR EC50 is given in CEA surface antigens/cell, but the actual target is a CEA pMHC. For IC50, different amounts of HLA-A*02 mRNA were co-transfected with 125 ng CEA mRNA into cells before co-culture. Killing was monitored for 48 hours. The decrease in killing, normalized to Kmax, was plotted against A*02 mRNA amount. The IC50 of HLA-A*02 blocking CEA Tmod is ~6.8 ng of mRNA and ~100K molecules/cell using standard curves in FIG. 22. Standard curves were used to relate mRNA levels (see FIG. 18) to surface protein molecules, and the results are shown in FIG. 19. These experiments demonstrated that EC50 and IC50 measured in Jurkat cell assays were comparable to the equivalent sensitivity parameters derived from T cell cytotoxicity assays.

Figure 21:
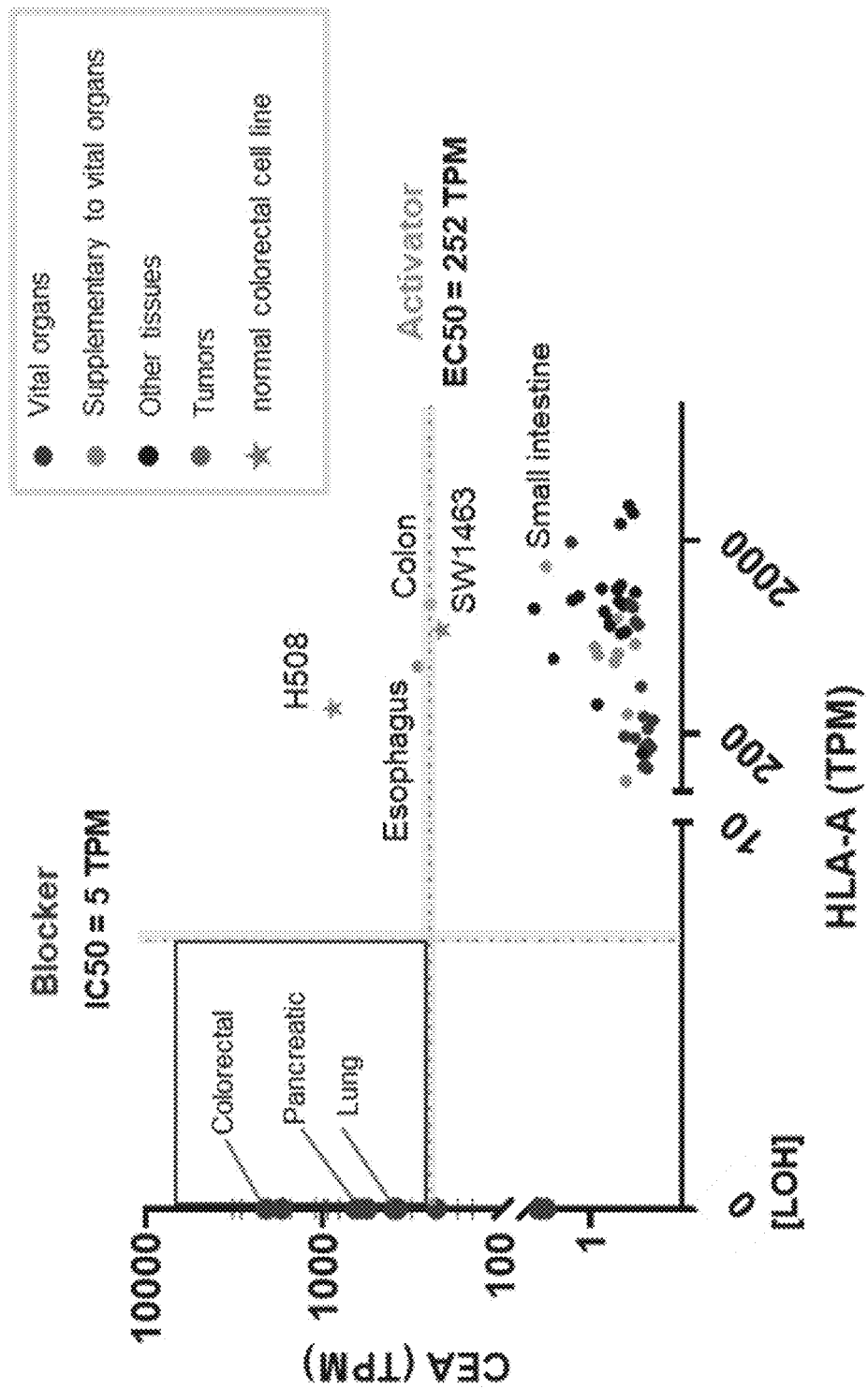
FIG. 21 shows that the combination of CEA CAR and HLA-A*02 inhibitory receptor is predicted to kill tumors while protecting normal tissues. TPM: transcripts per million; A*02: HLA-A*02; LOH: loss of heterozygosity.

FIG. 21 shows the CEA CAR and HLA-A*02 inhibitory receptor EC50 and IC50 on a graph with the tumor and normal expression values for the CEA and A*02 antigens. In FIG. 21, data in CEA standard curve replotted from Bacac, M. et al. (2016) Clin Cancer Res 22, 3286-3297. EC50 and IC50 values were determined. Tumor types had HLA-A expression set at 0 TPM to account for selection of HLA-A*02(-) tumors by LOH. Tumor data was from the TCGA database and normal tissue data was from GTEx database.

Most normal tissues express CEA well below the EC50 of the two-receptor combination. The exceptions are colon and esophagus, which fall in the quadrant above the CEA EC50 in FIG. 21. However, all normal tissues, including colon and esophagus, have expression levels of HL-A*02 well above the blocker receptor IC50 and are thought to be safe from CEA-directed killing by immune cells expressing the receptor combination. Many solid tumors, notably colorectal, pancreatic, and lung, express CEA levels above the EC50. These malignant tissues are expected to activate CEA CAR in immune cells expressing the two receptors in the absence of HLA-A*02 expression (i.e., when selected for LOH).

Figure 23:
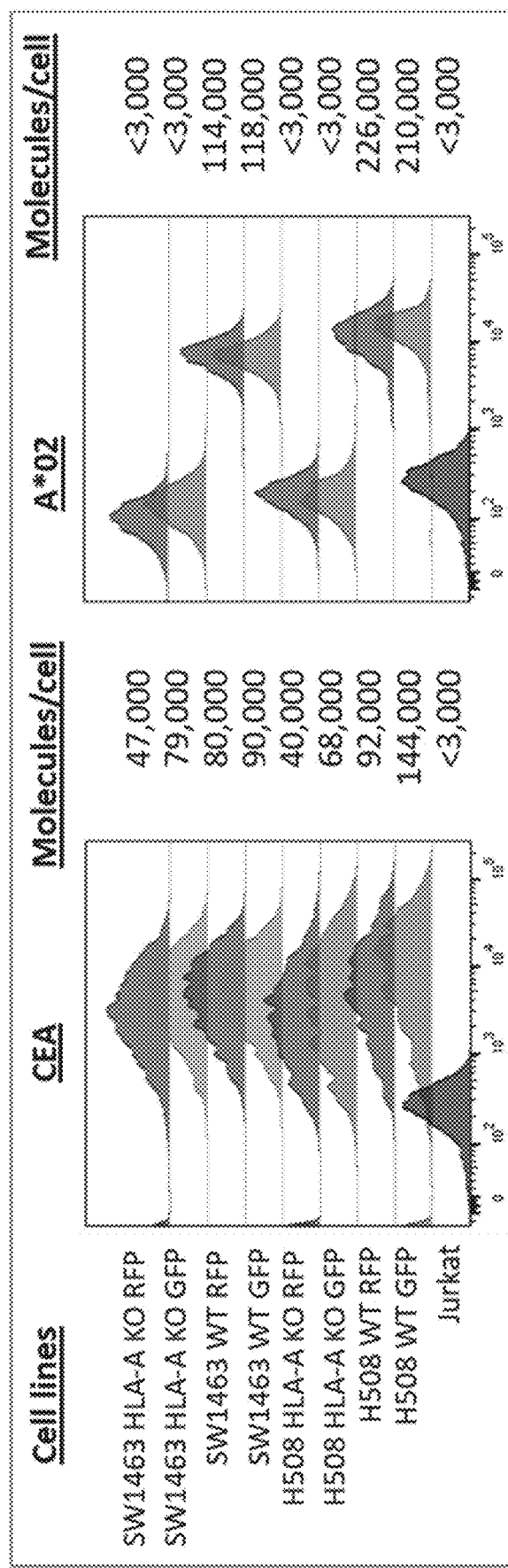
FIG. 23 shows surface expression of CEA and HLA-A*02 on H508 and SW1463 cell lines. WT: wild type; KO: indicated gene is knocked out.

A variety of colon cancer cell lines were characterized to identify lines representative of native levels of antigen expression in normal colon. Colon cancer lines H508 and SW1463 were selected (Table 26). Both are heterozygous for HLA-A*02 and express CEA. Comparison of RNA-Seq datasets showed that these lines express CEA and HLA-A at levels that reflect expression of these genes in normal colon. To create target cell lines to use as target-related controls, gene knockout versions of H508 and SW1463 that lacked either HLA-A*02 or CEA expression were generated (FIG. 23). As shown in FIG. 23, the H508 and SW1463 lines prior to genetic manipulation have antigen numbers and HLA-A*02:CEA expression ratios similar to normal colon tissue. To make variants for testing, stable pools of HLA-A*02-deficient cells were derived from CRISPR knockout and analyzed here by flow cytometry after staining with CEA or HLA-A*02 mAbs. All cell lines were from fresh thaws of early passage vials.

Figure 24:
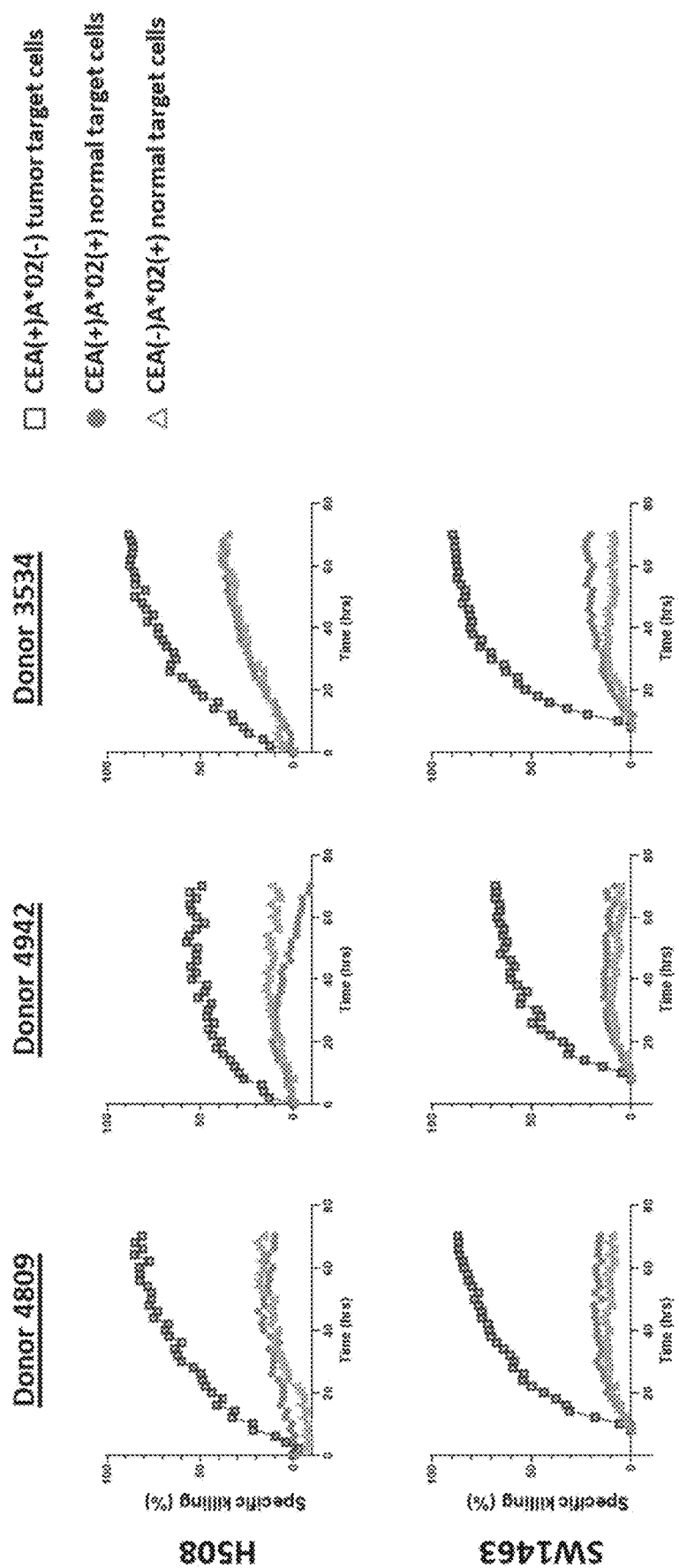
FIG. 24 shows cytotoxicity data of CEA Tmod expressing cells (cells expressing both the CEA CAR and HLA-A*02 scFv inhibitory receptor) derived from three HLA-A*02(−) donors, which were assayed with colorectal cell lines as targets. A*02: HLA-A*02.

The selective response of CEA CAR Tmod cells (cells expressing the dual CEA CAR and HLA-A*02 scFv LILRB1 inhibitory receptor system) to H508 and SW1463 colorectal cancer lines with endogenous antigen expression was confirmed in primary T cell cytotoxicity assays (FIG. 24). In FIG. 24, raw data were plotted without background subtraction. A time course using background (CEA(-) HLA-A*02(+) cells, in triangles) was also carried out. Tumor and normal target cells were H508 and SW1463 with or without genetic modifications, as shown in the key at right. Two separate vectors (one for the activator receptor and one for the blocker receptor) were used to transduce donor T cells, without an shRNA to knock down B2M. All donors were HLA-A*02(−).

FIG. 24 shows an example of how the Tmod dual receptor system enables the selective killing of H508 target cells. In FIG. 24, three NCI-H508-RFP target cell lines were used: CEA+ HLA-A*02(+) (normal, filled circles), CEA− HLA-A*02(+) (normal, triangles) and CEA+ HLA-A*02(−) (tumor, squares). Cytotoxic assay was performed at a 3:1 effector-to-target ratio. Specific killing was determined based on the total pixel area of RFP or GFP signal present in the transduced T-cell co-culture and expressed as percent relative to the untransduced T-cell co-culture control.

Figure 25:
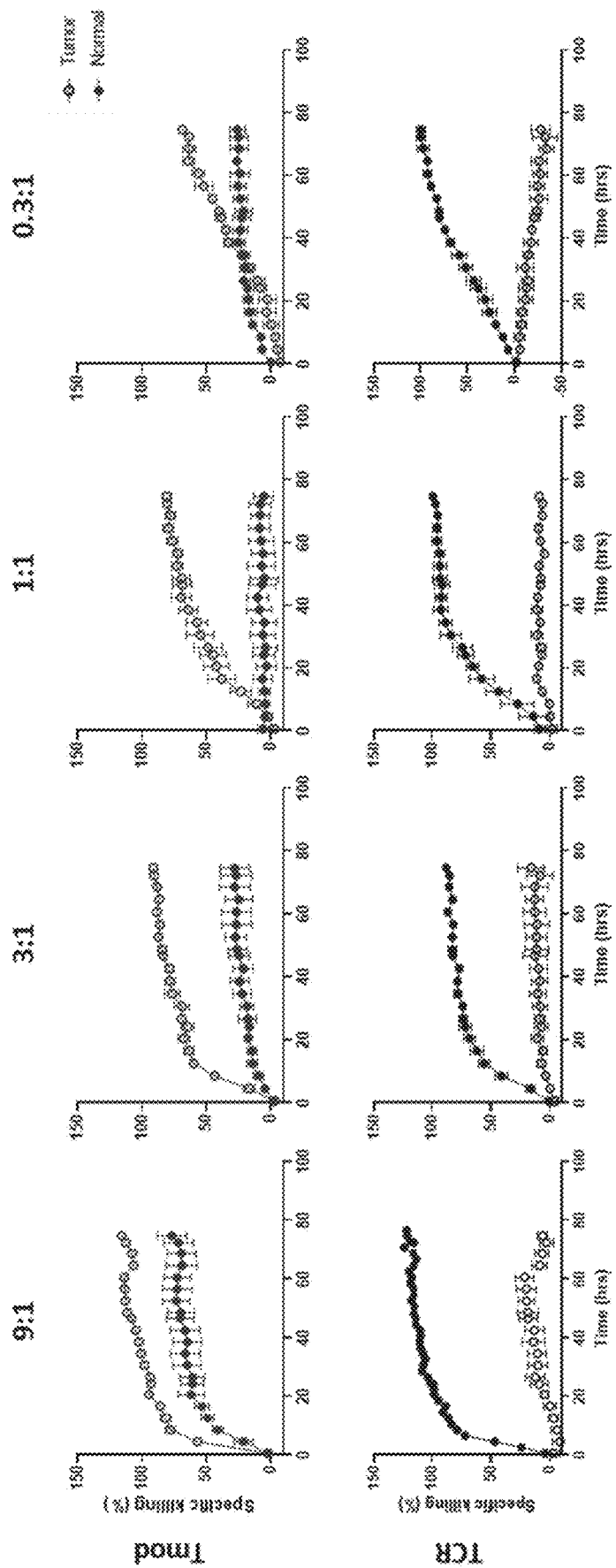
FIG. 25 shows a time course of CEA CAR Tmod and TCR T killing of tumor and normal cells at different E:T ratios using HLA-A*02(+) donor T cells transduced with the CEA TCR or the Tmod dual receptor system.
Figure 32:
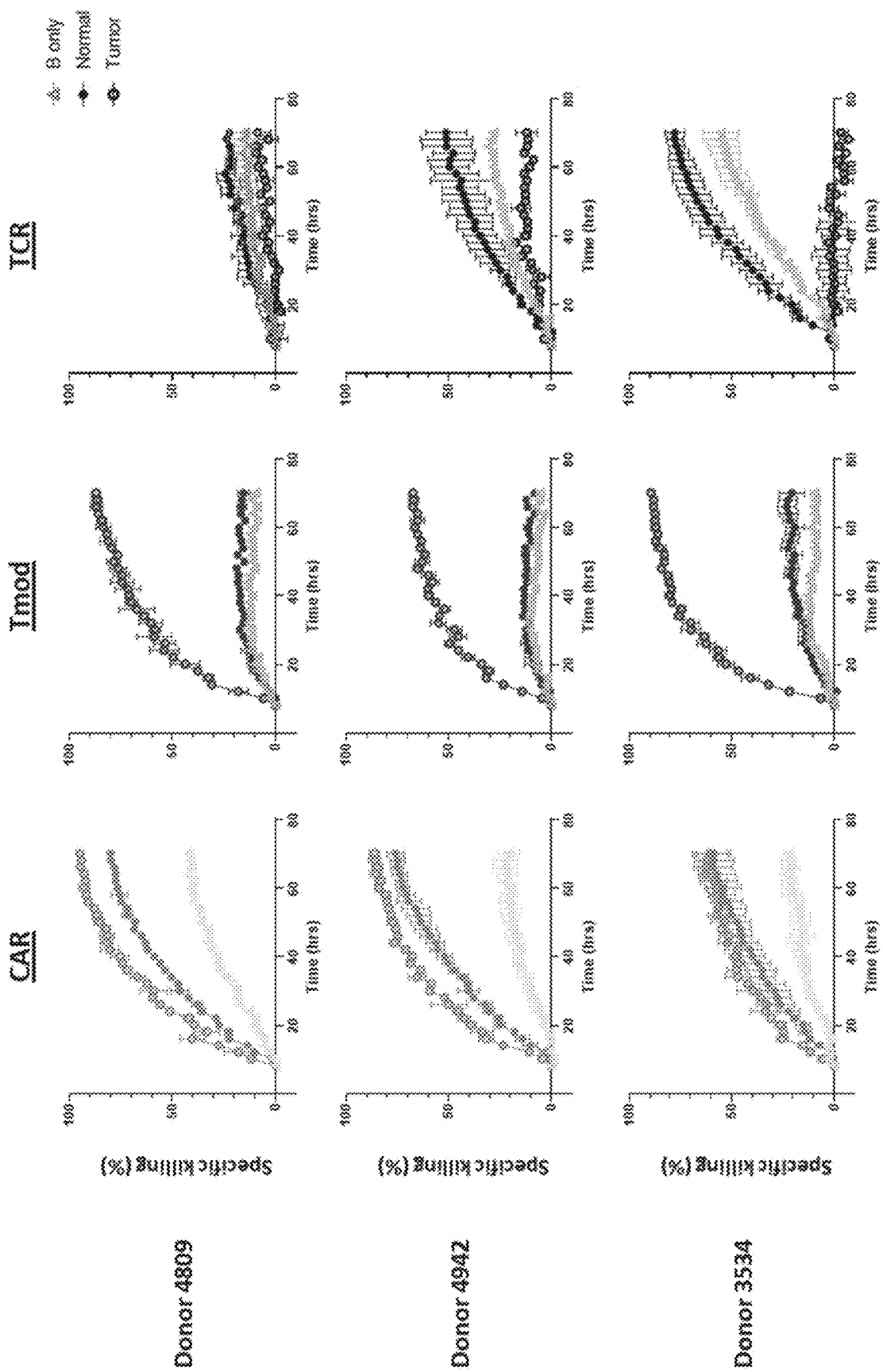
FIG. 32 shows cytotoxicity assays with effector T cells expressing the CEA CAR Tmod dual receptors and CEA(+) target cell lines. E:T was 3:1 for target cell co-cultures, H508 target cells were used. B only refers to CEA(−) HLA-A*02 (+) target cells.
Figure 33:
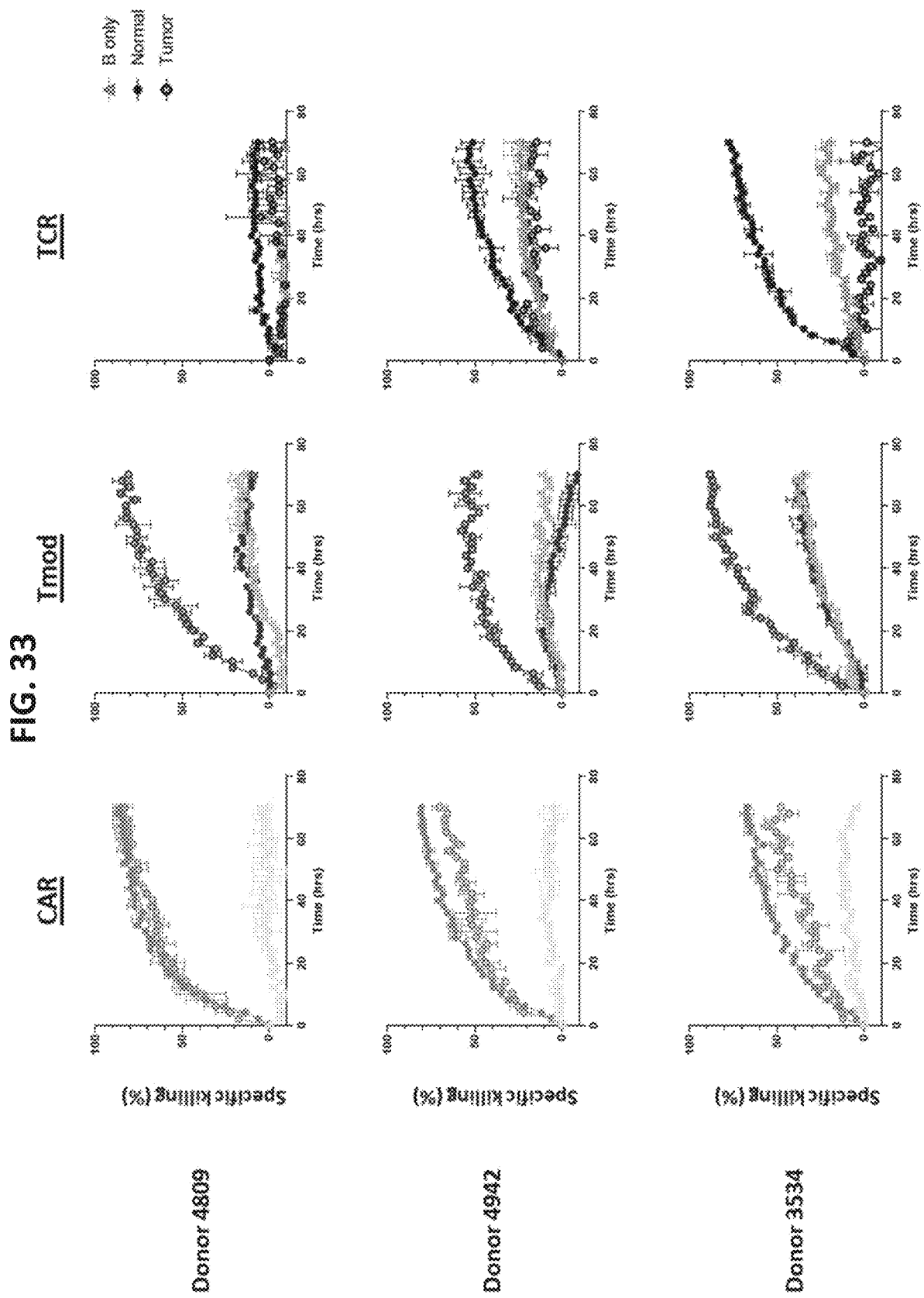
FIG. 33 shows cytotoxicity assays with effector T cells expressing the CEA CAR Tmod dual receptors and CEA(+) target cell lines. E:T was 3:1 for target cell co-cultures, SW1463 target cells were used. B only, CEA(−) HLA-A*02 (+) target cells.
Figure 34:
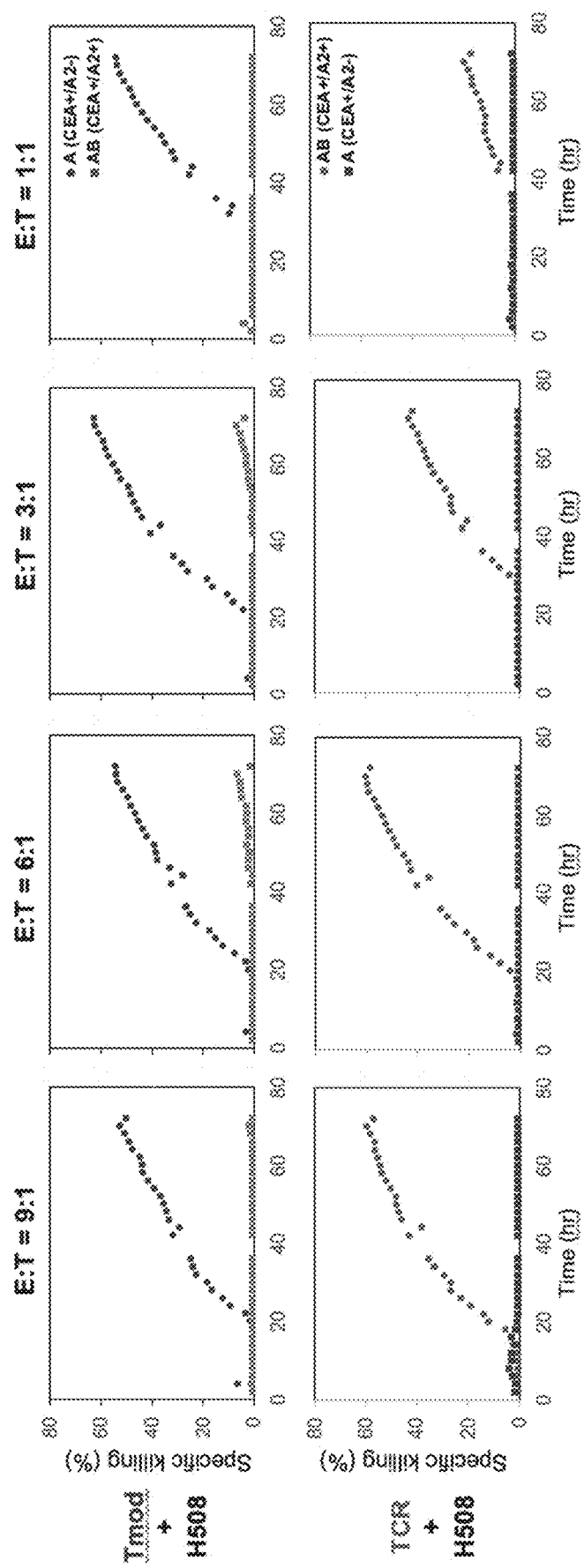
FIG. 34 shows that effector T cells expressing the CEA Tmod dual receptors (cells were transduced using separate activator and blocker lentiviral vectors) enables selective killing of tumor vs. normal cells in the colorectal cancer cell line H508. T cells expressing the Tmod receptors were as sensitive, but more selective, for normal cells than the benchmark CEA TCR. T cells were derived from an HLA-A*02(−) donor (D4809).

Both the CEA CAR Tmod expressing cells and the benchmark TCR demonstrated comparable target-selective cytotoxicity at low E:T ratios (FIG. 25). In FIG. 25, background killing of CEA(−) HLA-A*02(+) target cells was subtracted from specific killing. In the absence of a functional HLA-A*02 gene, the TCR was inactive even at E:T=9:1. At this ratio, the CEA CAR Tmod expressing cells demonstrated reduced selectivity for HLA-A*02(−) target cells. This difference between the Tmod expressing and TCR expressing cells may be partly related to the donor haplotype, as it was not seen in HLA-A*02(C) donors (FIGS. 32-34) and/or the extreme difference in absolute antigen levels of their respective targets: a pMHC for the TCR and CEA surface antigen for the CEA CAR construct.

Figure 26:
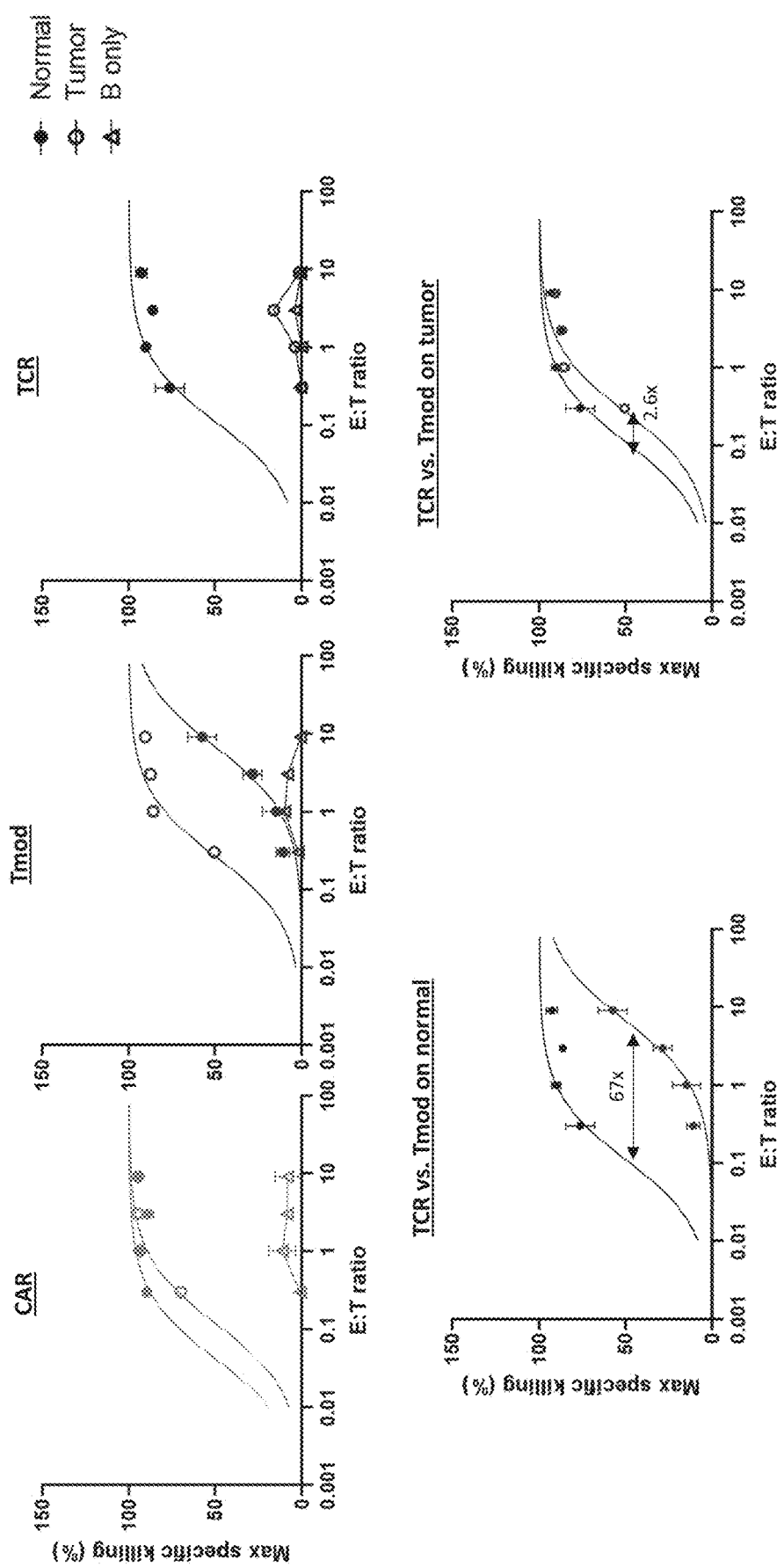
FIG. 26 shows that effector cells expressing the CEA CAR Tmod dual receptor system kill tumor cells similarly to cells expressing the CEA TCR, but are ~70× less active in killing CEA(+) HLA-A*02(+) normal H508 target cells. tumor: CEA(+) HLA-A*02(−) target cells; B only: target cells express HLA-A*02 only; normal: CEA(+) HLA-A*02 (+) target cells.

Unlike the TCR expressing cells, CEA CAR Tmod expressing cells were able to distinguish CEA(+) HLA-A*02(−) tumor cells from CEA(+) HLA-A*02(+) normal cells based solely on expression of the blocker antigen, displaying ~70× shift in response vs. E:T ratio (FIG. 26). In contrast, the TCR was nonselective against the normal cells, consistent with its clinical profile.

TABLE 25

CEA(+) target cell lines compared to normal colon expression of CEA and A*02 antigens

| Cell line | CEA | | HLA-A*02 | | HLA-A*02/CEA | |
|---|---|---|---|---|---|---|
| | Mol./cell | TPM | Mol./cell | TPM | Mol. | TPM |
| Jurkat [CEA(−)A*02( )] (negative control) | 20 | NA | 8 | NA | | |
| H508 [CEA(+)A*02(+)] | 92-144k | 527 | 210-220k | 389 | ~2 | 1.5 |
| H508 [CEA(+)A*02(−)] | 40-68k | | <3k | ND | | |
| SW1463 [CEA(+)A*02(+)] | 80-90k | 216 | ~110k | 344 | ~1.2 | 3.2 |
| SW1463 [CEA(+)A*02(−)] | 47-79k | | <3k | ND | | |
| HeLa [CEA(+)/A*02(+)] | 330k | N/D | 660k | ND | ~2 | |
| HeLa [CEA(+)/A*02(−)] | 350K | | <3.5k | | | |
| Normal colon | ND | ~250 | ND | ~930 | ND | 3.7 |

In Table 25, H508 and SW1463 are colorectal cancer cell lines with native CEA and HLA-A*02 expression. HeLa is a cervical cancer cell line that is CEA(−) and HLA-A*02(−). HeLa cells were genetically engineered to express CEA and HLA-A*02. Cells were stained and molecules/cell calculated as described above. TPM are for HLA-A. MFI, median fluorescence intensity; TPM, transcripts per million; NA: not applicable; ND, not done.

TABLE 26

Expression of CEA and A*02 (TPM) in 14 cell lines

| Cell line | Tissue origin | CEA (TPM) | HLA-A*02 (TPM, corrected by heterozygosity) | Gene modification to generate CEA(−) HLA-A*02(−) cells | | Gene modification to generate CEA(−) HLA0A*02(+) cells | |
|---|---|---|---|---|---|---|---|
| | | | | CEA | HLA-A*02 | CEA | HLA-A*02 |
| NIHOVCAR3 | ovary | 0 | 40 | — | KO | — | — |
| SW982 | soft tissue | 0 | 533 | — | KO | — | — |
| COLO668 | lung | 180 | 0 | KO | | KO | Overexpression |
| HEPG2 | liver | 0 | 245 | — | KO | — | — |
| U2OS | bone | 0 | 54 | — | KO | — | — |
| K562 | haematopoietic and lymphoid tissue | 0 | 0 | — | — | — | Overexpression |
| NCIH508 | Large intestine | 527 | 389 | KO | KO | KO | — |
| RAJI | haematopoietic and lymphoid tissue | 0 | 0 | | | | Overexpression |
| SHP77 | lung | 30 | 130 | KO | KO | KO | — |
| MS751 | cervix | 0 | 78 | — | KO | — | — |
| LNCAP_CLONE_FGC | prostate | 0 | 58 | — | KO | — | — |

TABLE 26-continued

Expression of CEA and A*02 (TPM) in 14 cell lines

| Cell line | Tissue origin | CEA (TPM) | HLA-A*02 (TPM, corrected by heterozygosity) | Gene modification to generate CEA(−) HLA-A*02(−) cells | | Gene modification to generate CEA(−) HLA0A*02(+) cells | |
|---|---|---|---|---|---|---|---|
| | | | | CEA | HLA-A*02 | CEA | HLA-A*02 |
| SW480 | large intestine | 0 | 205 | — | KO | — | — |
| A375 | skin | 0 | 110 | — | KO | — | — |
| A498 | kidney | 0 | 617 | — | KO | — | — |

Gene expression information was obtained from DepMap. The 14 cell lines were obtained from commercial sources. CEA(−) HLA-A*02(−) and CEA(−) HLA-A*02(+) isogenic cell lines were generated by knockout (KG) of CEA and/or HL-A*02 using CRISPR gene-editing and, in the cell lines lacking A*02, cells were transduced with lentiviral vector expressing A*02.

Figure 27:
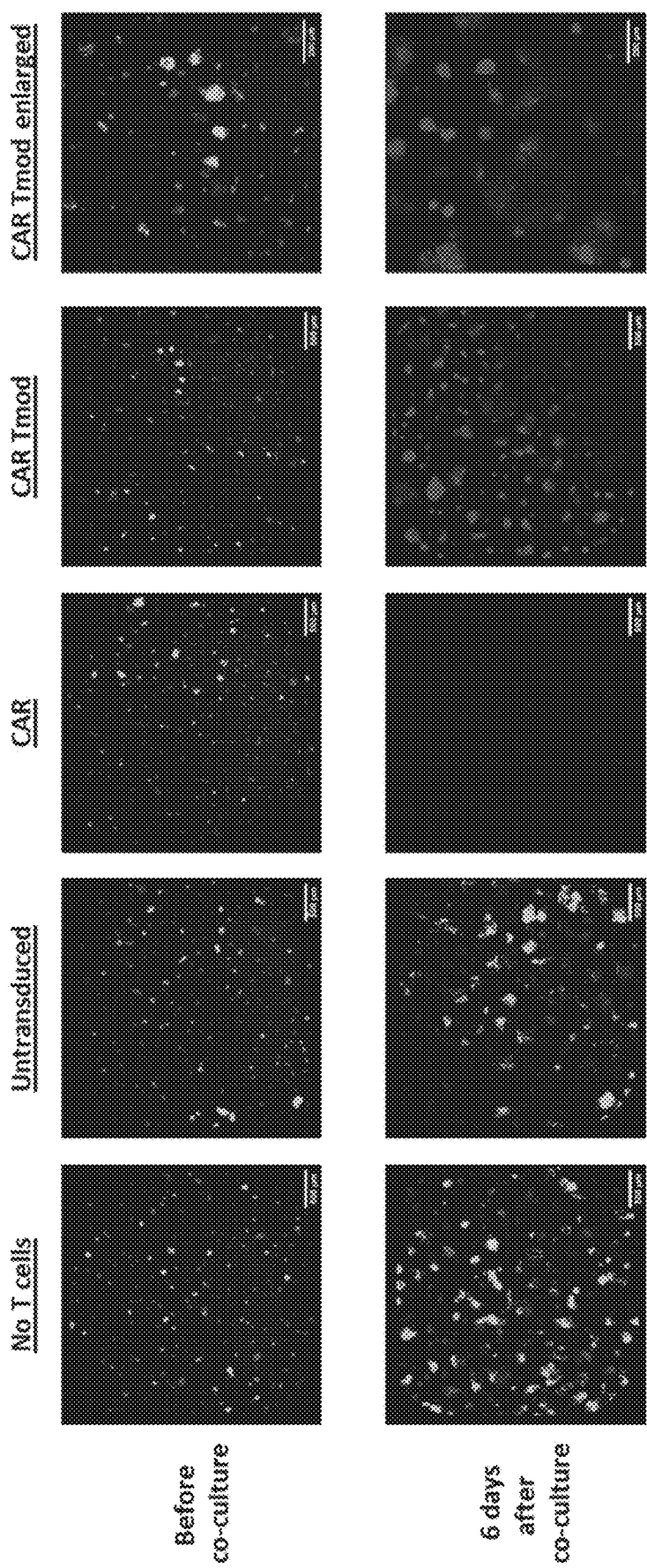
FIG. 27 shows selective cytotoxicity of effector cells expressing the CEA CAR Tmod dual receptors when presented with mixed tumor and normal cell cultures at a 1:1 ratio. The tumor cells were H508 CEA(+) HLA-A*02(−) cells that stably expressed GFP (green). Normal cells were H508 CEA(+) HLA-A*02(+) cells that stably expressed RFP (red). T cells were from HLA-A*02(+) donor D12333. Scale bar is 500 microns.
Figure 28:
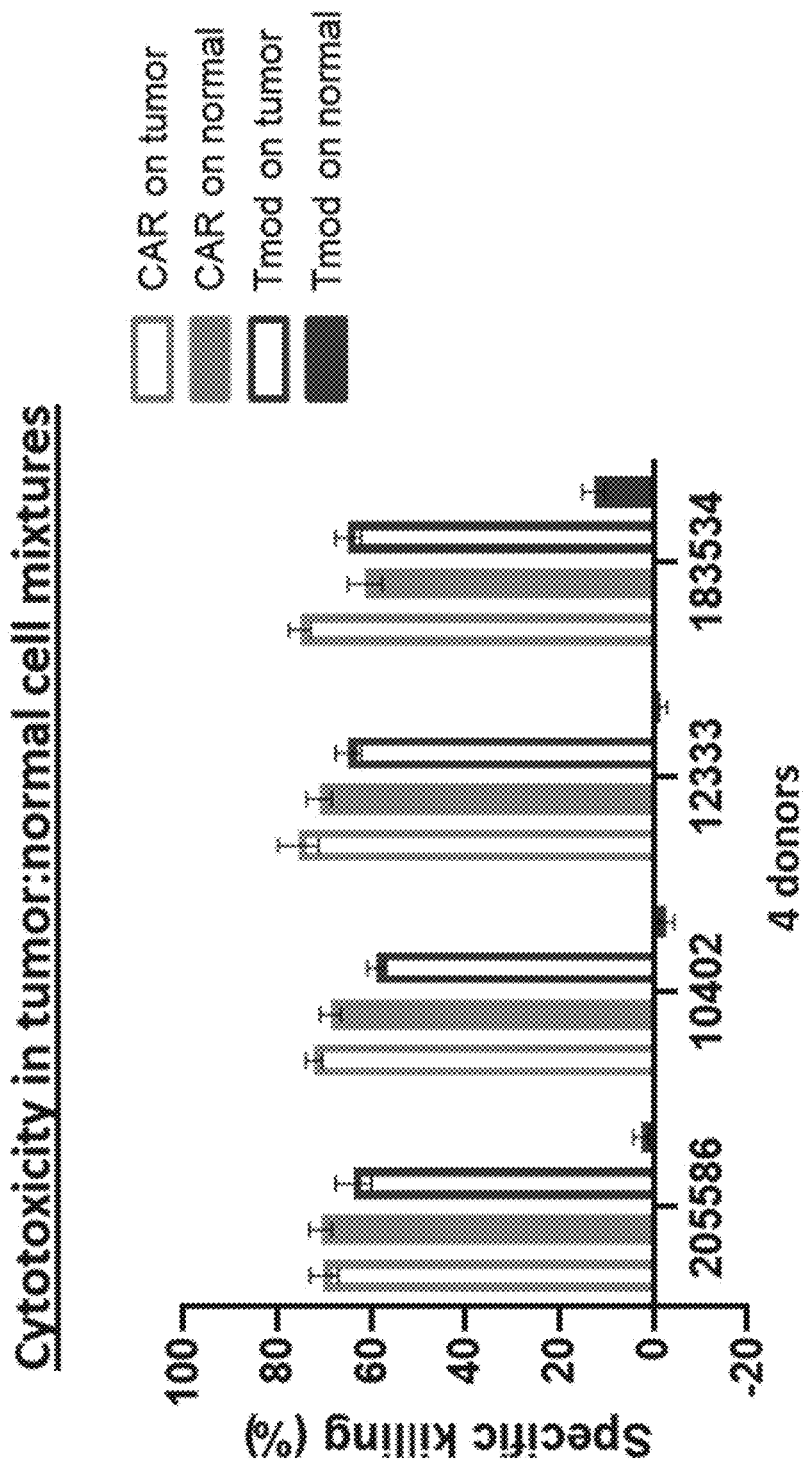
FIG. 28 shows a summary of specific killing effector cells expressing the CEA CAR and HLA-A*02 inhibitory receptor (Tmod) in 1:1 mixtures of tumor:normal target cells. H508 target cells genotypes were as in FIG. 26, and no IL-2 was added. Donor T cells were HLA-A*02(+) except for donor 183534.

Example 8: Tumor Discrimination and Reversible Activation in Mixed and Serial Cultures A series of experiments to test the function of cells expressing the CEA CAR Tmod dual receptor system (CEA CAR and HLA-A*02 scFv LILRB1 inhibitory receptor) in more challenging in vitro functional assays. First, the ability of cells expressing the two receptors to distinguish tumor from normal cells in mixed cell cultures was tested. Wild-type H508 cells were labeled with RFP to simulate normal cells and HLA-A*02 knockout (KO) isogenic cells were labeled with GFP and used to simulate tumor cells. The colored proteins provided a convenient readout for cell survival in vitro. The two labeled cell lines were mixed at a 1:1 ratio and co-cultured with effector T cells expressing the two Tmod receptors. Afterward, the target cells were visualized by microscopy. While T cells expressing the CEA CAR alone killed both tumor and normal lines completely, T cells expressing the CEA CAR and the inhibitory receptor killed only the tumor cells (FIGS. 27-28).

Figure 29:
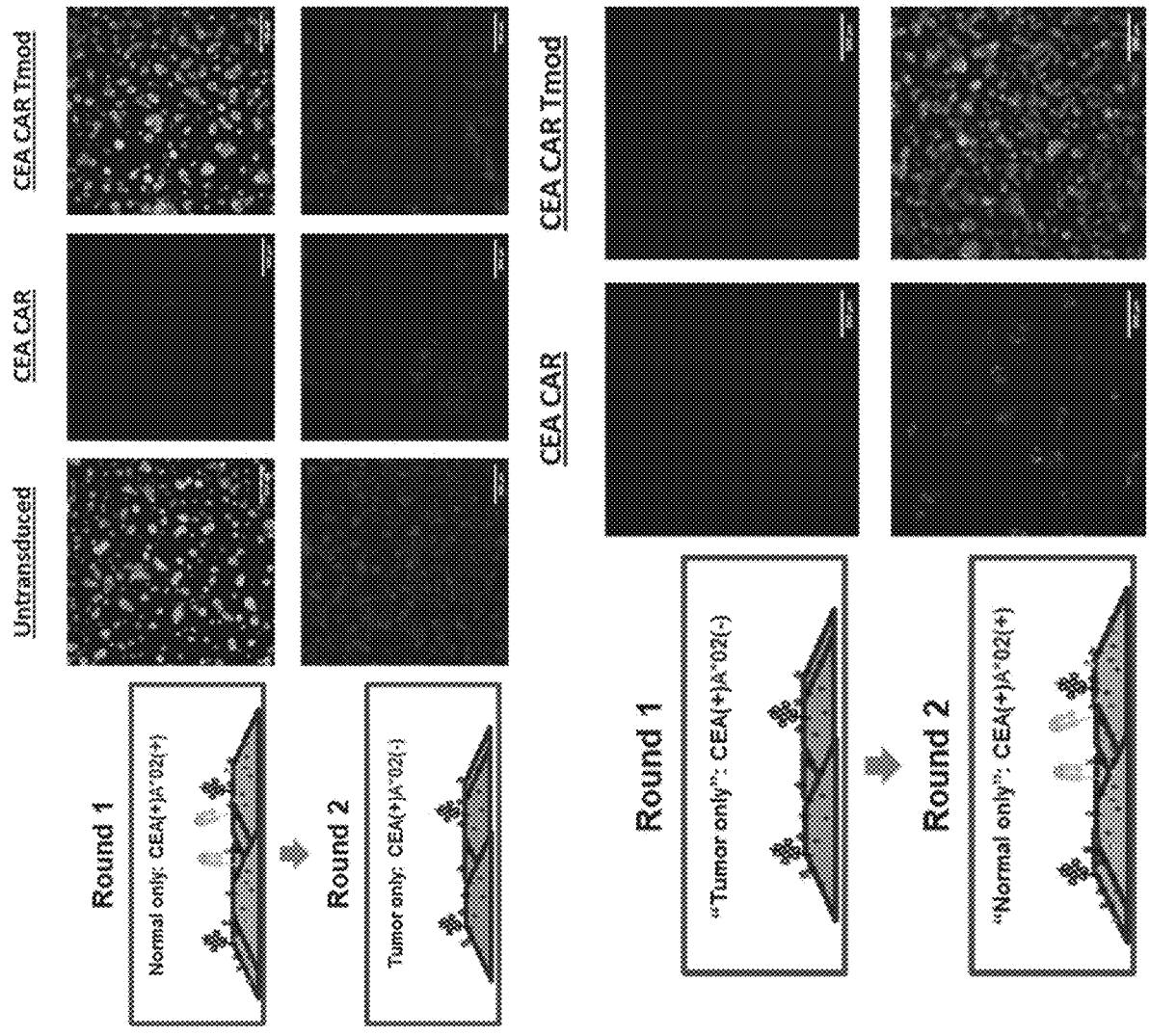
FIG. 29 shows image of targets cells co-cultured serially. For cytotoxicity assays T cells were transduced, enriched for blocker antigen, and transferred from one specific type of target cell to the next. Both normal and tumor cells are labeled with GFP but red pseudo-color is used to visualize tumor cells and green is used for normal cells. Scale bars indicate 500 microns.
Figure 30:
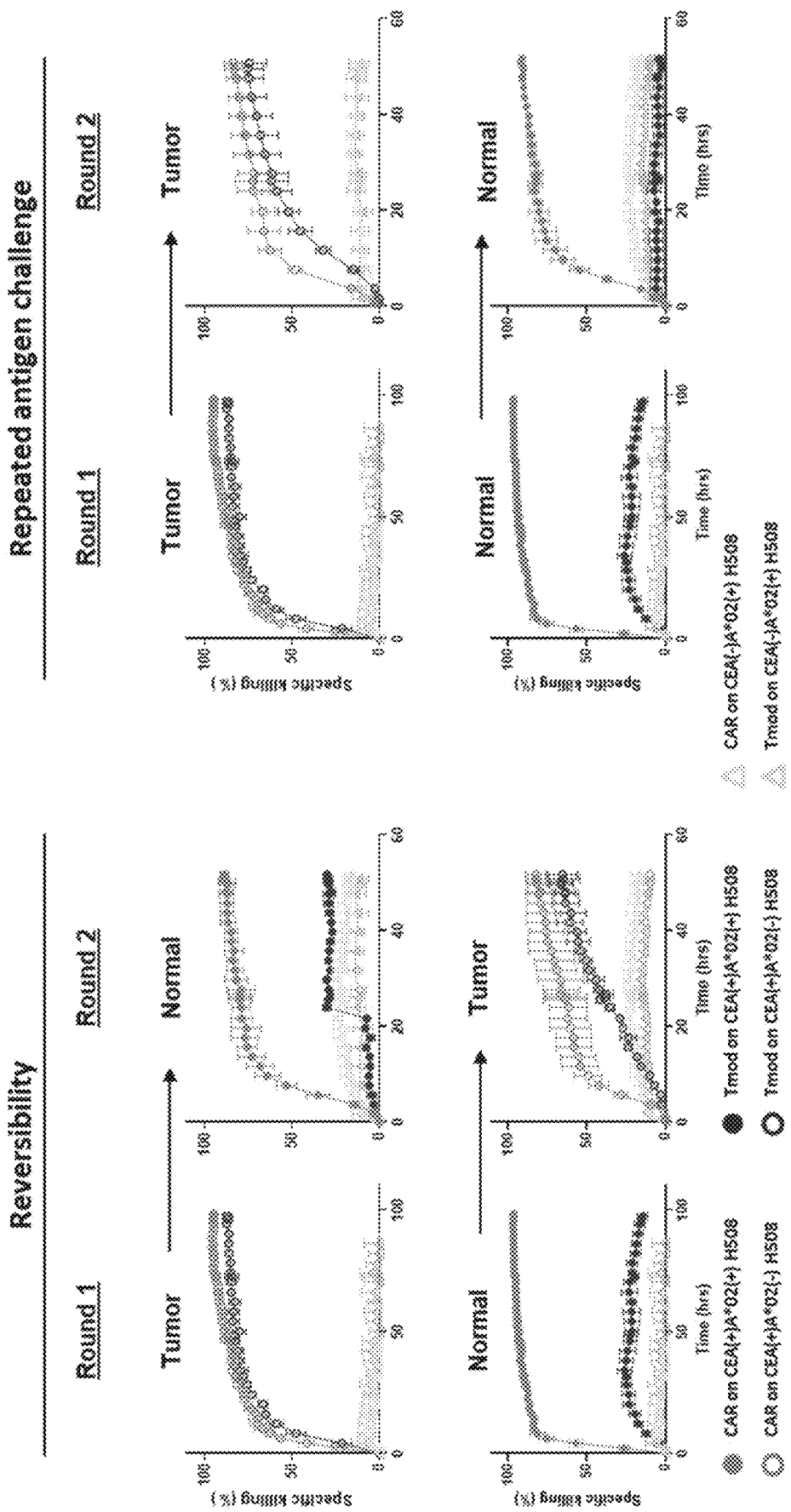
FIG. 30 shows a time course of CEA CAR Tmod expressing cells and CEA CAR expressing cells in a repeated antigen challenge. Horizontal arrows show the transfers from target cell type (tumor or normal H508). Donor T cells transduced with CEA CAR, or the Tmod dual receptors were HLA-A*02(+) (D12333).
Figure 35:
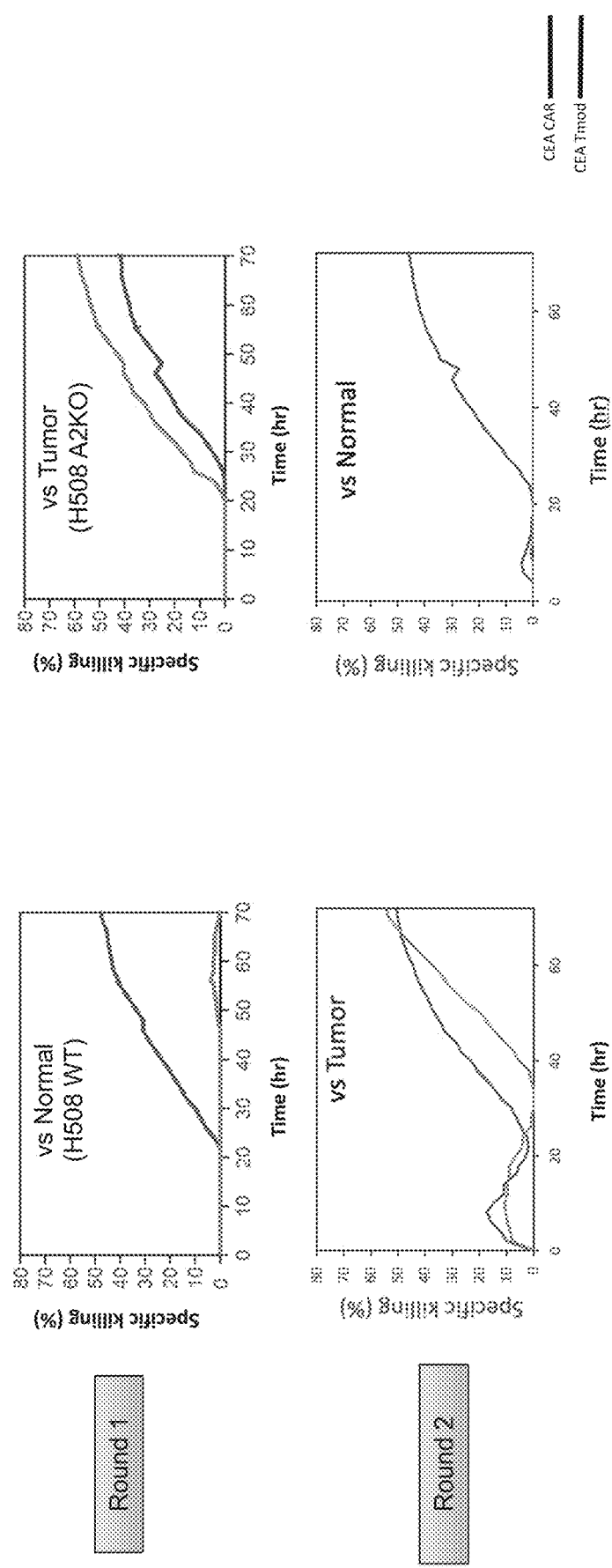
FIG. 35 shows quantification of reversible cytotoxicity by effector T cells expressing the CEA Tmod dual receptors (which were delivered via 2 separate lentiviral vectors), in HLA-A*02(−) donor cells (D4809). T cells were exposed first to either tumor or normal cells in round 1, then normal or tumor cells, respectively, in round 2 and selective tumor vs. normal cell killing was measured. WT: wild type; A2KO: HLA-A*02 knock out.

Next, the capacity of the CEA CAR Tmod dual receptors to mediate reversible activation, another property of a solid-tumor cell therapy, was assayed. Effector T cells expressing the CEA CAR Tmod receptors were cultured serially in the presence of different target cells, i.e. from tumor to normal or from normal to tumor, in order to simulate the experience of T cells in the body moving through a heterogeneous environment. The effector T cells expressing the Tmod dual receptors were able to switch sequentially between activated (ON) and blocked (OFF) states in both directions (FIGS. 29-30, FIG. 35).

Figure 31:
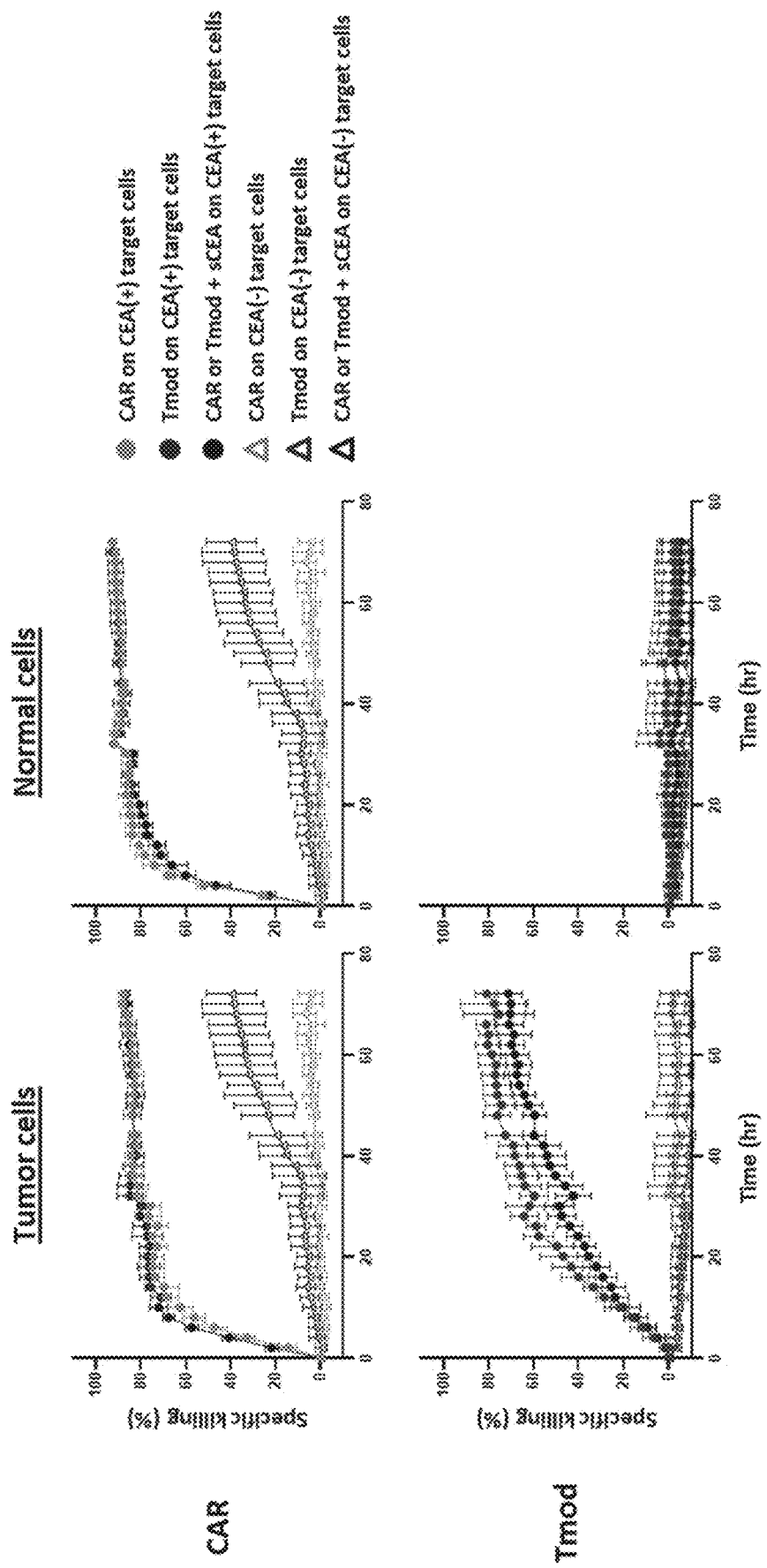
FIG. 31 shows that the presence of soluble CEA (sCEA; 10 ug/mL) does not significantly affect CEA CAR Tmod cytotoxicity in H508 cells. Genotypes of tumor, normal, and B as follows: tumor: CEA(+) HLA-A*02(−) target cells; normal: CEA(+) HLA-A*02(+) target cells; B: CEA(−) HLA-A*02(+) target cells.

Finally, the sensitivity of effector T cells expressing the two receptors was not affected by exogenous soluble CEA (sCEA), even at the highest levels detected in patients' blood (FIG. 31). Representative data from one HLA-A*02(+) donor (D12333) is shown in FIG. 31, and T cells from four donors were tested. sCEA activated the CEA CAR in T cells from all 4 donors at longer time points. The presence of sCEA (10 ug/mL) did not significantly influence cytotoxicity of effector T cells expressing both Tmod receptors across multiple donors. Interestingly, the CEA CAR appeared to react to sCEA at longer time points. This activation, possibly derived from CEA aggregated on the cell surface, was not detected in cells expressing both Tmod receptors.

Example 9: Off Target Reactivity Against Cell Lines that do not Express CEA

One consideration for all cell therapeutics, including this one, is off-target reactivity. Therefore, a process to test for functional off-target reactivity beyond the target-specific cell selectivity arising from activator- and blocker-antigen expression was established. It is worth noting that for the dual receptor system described here, clinical on-target safety (tumor vs. normal cells), is primarily achieved not by the activator receptor but by the blocker receptor, which responds to the presence or absence of its cognate blocker antigen. Normal cells that ubiquitously express the blocker antigen, HLA-A*02, are protected from cytotoxicity, reducing the on-target, off-tumor risk. This safety mechanism also protects patients from off-target reactivity. Activation by any potential engagement of the activator receptor with off-target molecules will be inhibited by the ubiquitous presence of HLA-A*02 protein which engages the blocker receptor.

Figure 36:
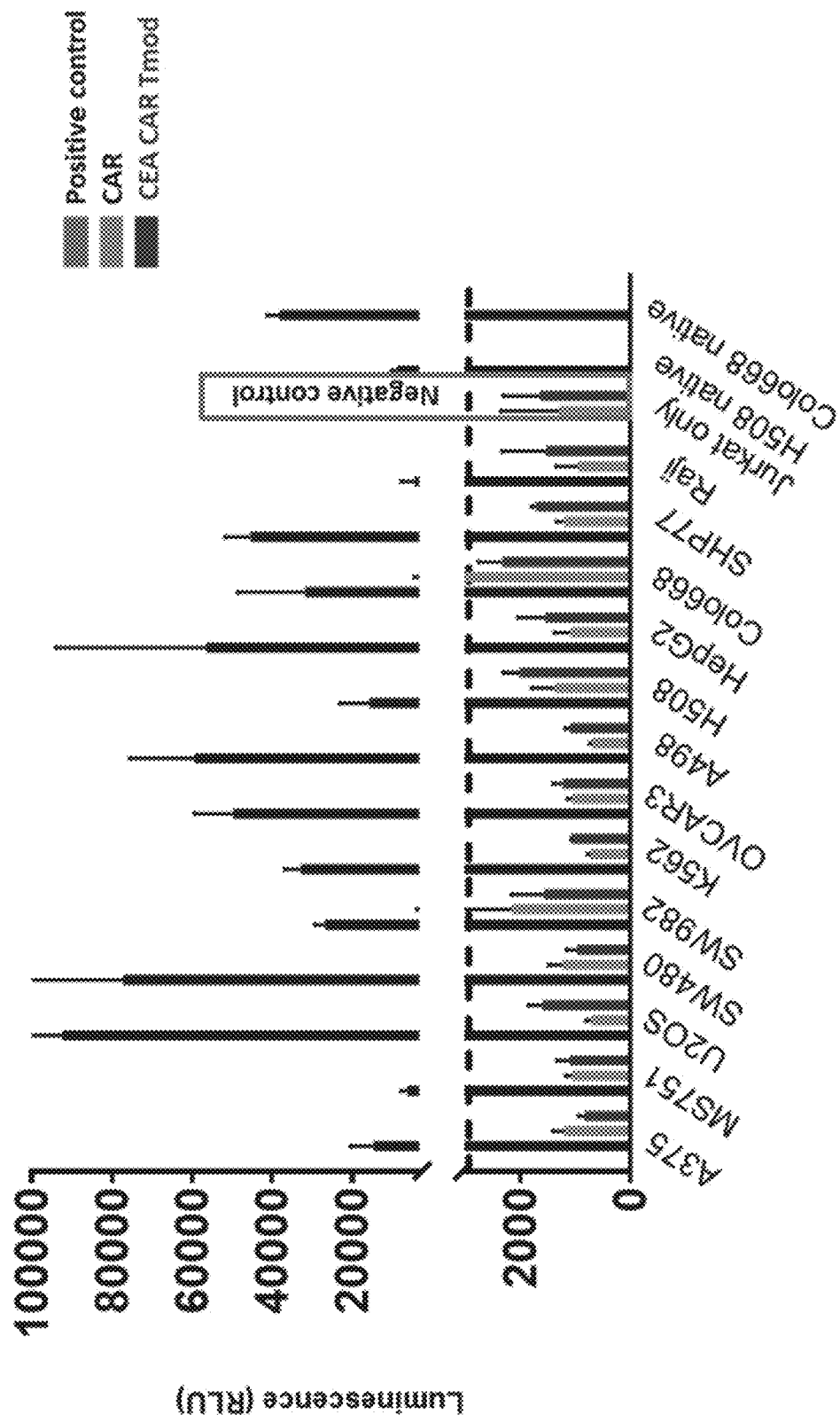
FIG. 36 shows Jurkat cell assays of CEA CAR Tmod dual receptor off-target selectivity using a cell line panel chosen to represent greater than 90% of human adult tissue gene expression. Jurkat effector cells expressing the Tmod receptors were co-cultured with individual target cell lines described in Table 26. Positive control cell lines, which represent tumor cells, were transfected with 2 ug of CEA mRNA or natively expressed CEA. Normal cells are CEA(−) HLA-A*02(+). The horizontal dashed line is placed at the mean+2× the standard deviation (SD) of data from Jurkat cells (expressing the Tmod receptors) alone. Co-cultures were of 10,000 (10K) Jurkat cells and 10K target cells in each well. Left bars: Jurkat cells expressing the Tmod dual receptors with CEA+ HLA-A*02(−) cells; Middle bars: CAR expressing Jurkat cells with CEA(−) target cells; right bars, Jurkat cells expressing both receptors with CEA(−) HLA-A*02(+) target cells. Negative controls are in the grey box.

Human cell lines were used as surrogates for normal tissues in the body, and diverse cell-line panel that represents ~90% of adult gene expression at the level of >0.5 transcripts/cell was assembled (Table 26). A combination of transgenic and gene-knockout lines were used to generate both positive and negative controls. None of the target cell lines that were CEA-triggered a significant response above background level in Jurkat effector cells (hat expressed CEA CAR Tmod receptor constructs (FIG. 36). COLO 668 cells stimulated response in CEA CAR expressing Jurkat cells but not in CEA CAR Tmod Jurkat cells expressing both receptors. However, this response was not observed for either the CAR alone, or the CAR in combination with the inhibitory receptor, in primary T cells. These findings suggest that CEA CAR Tmod expressing cells have a low probability of off-target functional activity based on Jurkat cell assays.

Figure 37:
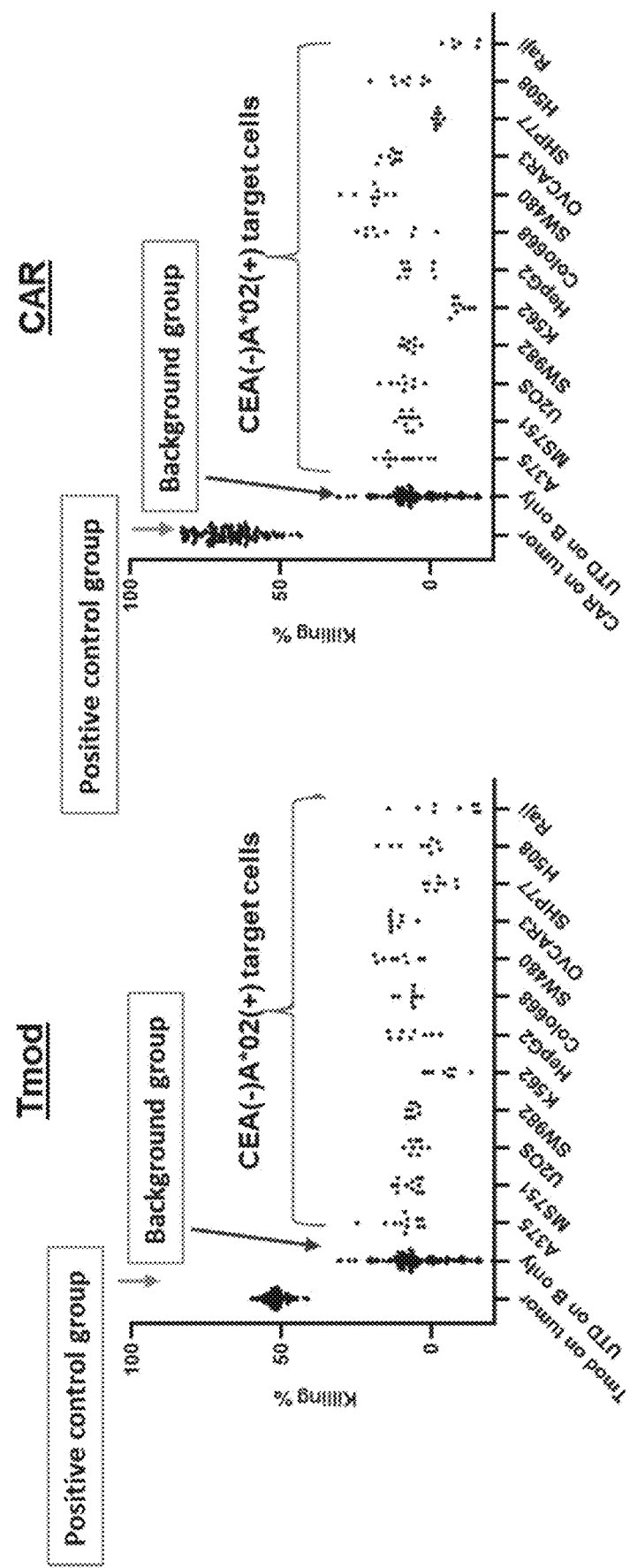
FIG. 37 shows a summary of cytotoxicity data for effector T cells expressing the CEA CAR Tmod dual receptors derived from 3 HLA-A*02(+) donors. UTD, untransduced.
Figure 38:
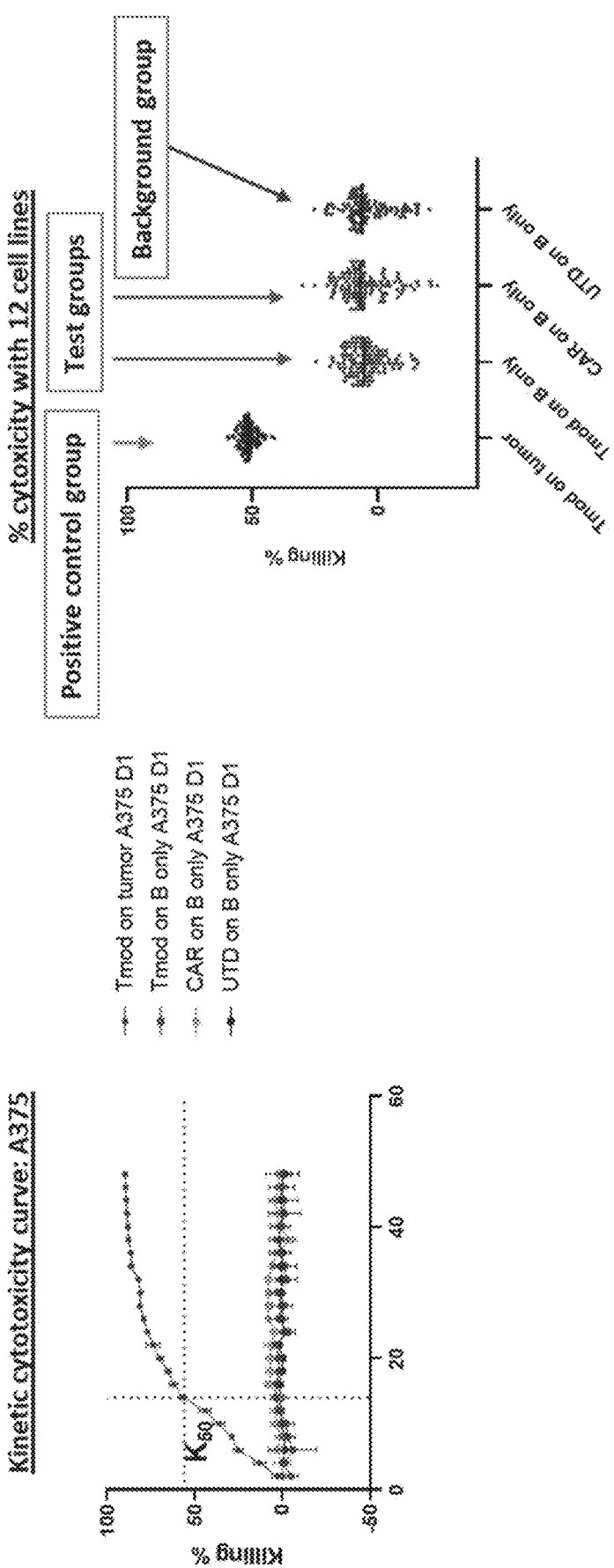
FIG. 38 shows a summary of selectivity data using primary T effector cells.

The same approach was used to test cytotoxicity of primary T cells expressing the CEA CAR Tmod receptors. Time points where the CEA CAR Tmod expressing cells killed ~50% of the CEA mRNA-transfected positive-control cell lines were selected ($K_{50}$; FIGS. 37-38). In FIG. 37, T cells were tested against the cell line panel described in Table 26. One HLA-A*02(−) donor was tested on A375 and MS751 cells. The E:T ratio used was 3:1. The time at which the Tmod dual receptor expressing cells reached greater than or equal to 50% killing on tumor cells (tK50) was chosen to compare % killing by the T cells expressing CEA CAR alone, both CEA CAR Tmod receptors, and untransduced T cells. As negative control, CEA(−) cell lines were co-cultured with untransduced T cells. The mean 50% target-cell killing (K50) of T cells expressing the CEA CAR Tmod dual receptors with tumor cells as targets, i.e. CEA(+) HLA-A*02(−) target cells, was ~6× above the background mean of the untransduced T cell co-cultures.

In FIG. 38, all killing in % was normalized against the growth of target cells only (no T cells). An example of kinetic data from one cell line (A375) is shown at the left. The cell line was transfected with 1 ug of CEA mRNA. All data are from E:T 3:1 experiments. The time at which Tmod cells reached greater than or equal to 50% killing on tumor cells was chosen to compare % killing by the CEA CAR, CEA CAR Tmod and untransduced T cells. All donor measurements (3-4 donors) on 12 different target cell lines were pooled for the right graph. The high end of dynamic range (positive controls) at Tmod T cells with tumor target cells [CEA(+)A*02(−)] at $K_{50}$, was estimated using the highest transfected CAR mRNA level. Background was estimated from untransduced T cells with CEA(−) target cells. Cross reactivity was estimated from the individual cell line means from the Tmod and CAR expressing Jurkat cells with the target cells (test groups).

Wild-type CEA(+) H508 triggered a strong response from CEA CAR-T cells. No significant off-target responses were detected with CEA CAR Tmod cells and CEA(−) target cells. Thus, the primary T cell cytotoxicity assay yielded no evidence of off-target activation by the CEA CAR Tmod construct. Notably, both Jurkat and primary T cell assays can detect functional target interactions at levels <100 molecules/cell, at least 1,000× lower than CEA is estimated to be present on the surface of H508 cells and normal colon epithelium.

Example 10: Tumor-Specific Efficacy in a Mouse Model

Figure 39:
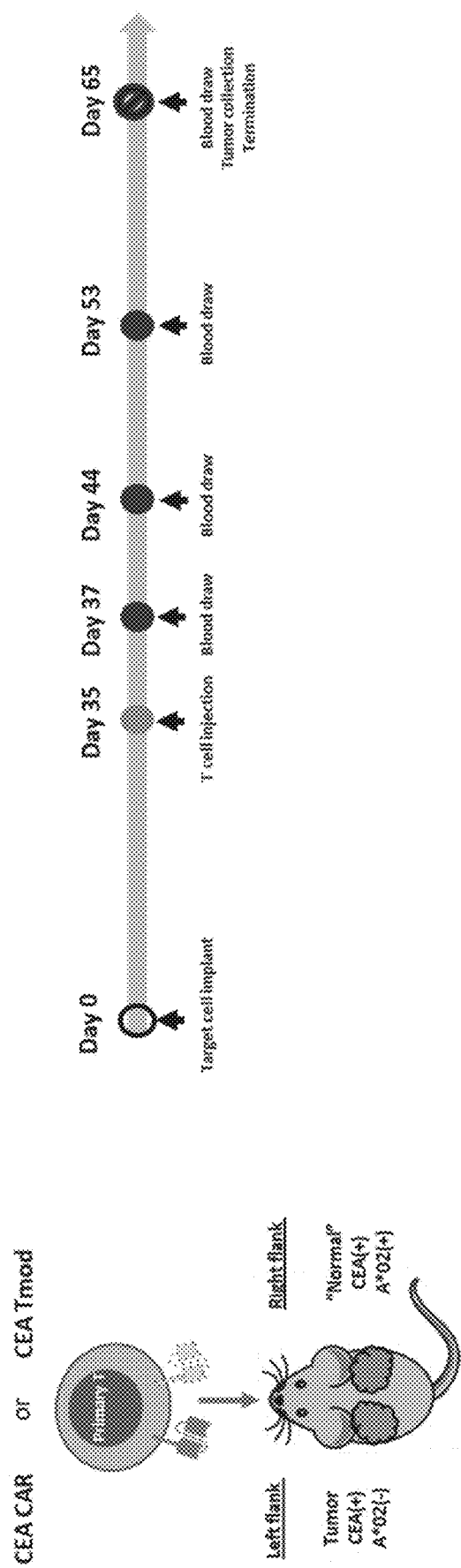
FIG. 39 shows the design of a mouse xenograft study with human T cells expressing CEA CAR or the CEA Tmod dual receptors. Xenograft experimental design and tumor volume vs. time are shown.

In vivo experiments were used confirm function of T cells expressing the CEA CAR Tmod dual receptors in mouse xenografts (FIG. 39). A single lentiviral vector encoding either the CEA CAR, or the dual receptor system, was used to transduce T cells from an HLA-A*02(−) donor, without a B2M shRNA. Donor T cells were HLA-A*02(−) (D4809). The cell line H508 chosen for the xenograft study, to reflect normal expression levels of CEA and HLA-A*02. Two dose levels of CEA CAR T or CEA CAR Tmod cells (from an HLA-A*02(−) donor) were used: 5E6 and 2E7 cells per mouse. After scaling up T cell production with IL-2, the enriched lentivirus-transduced primary T cells were infused via the tail vein of mice harboring two types of H508 tumor, one on each flank: one from CEA(+) HLA-A*02(+) normal cells to model normal colon epithelium and one from CEA(+) HLA-A*02(−) cells to model tumor.

Figure 40:
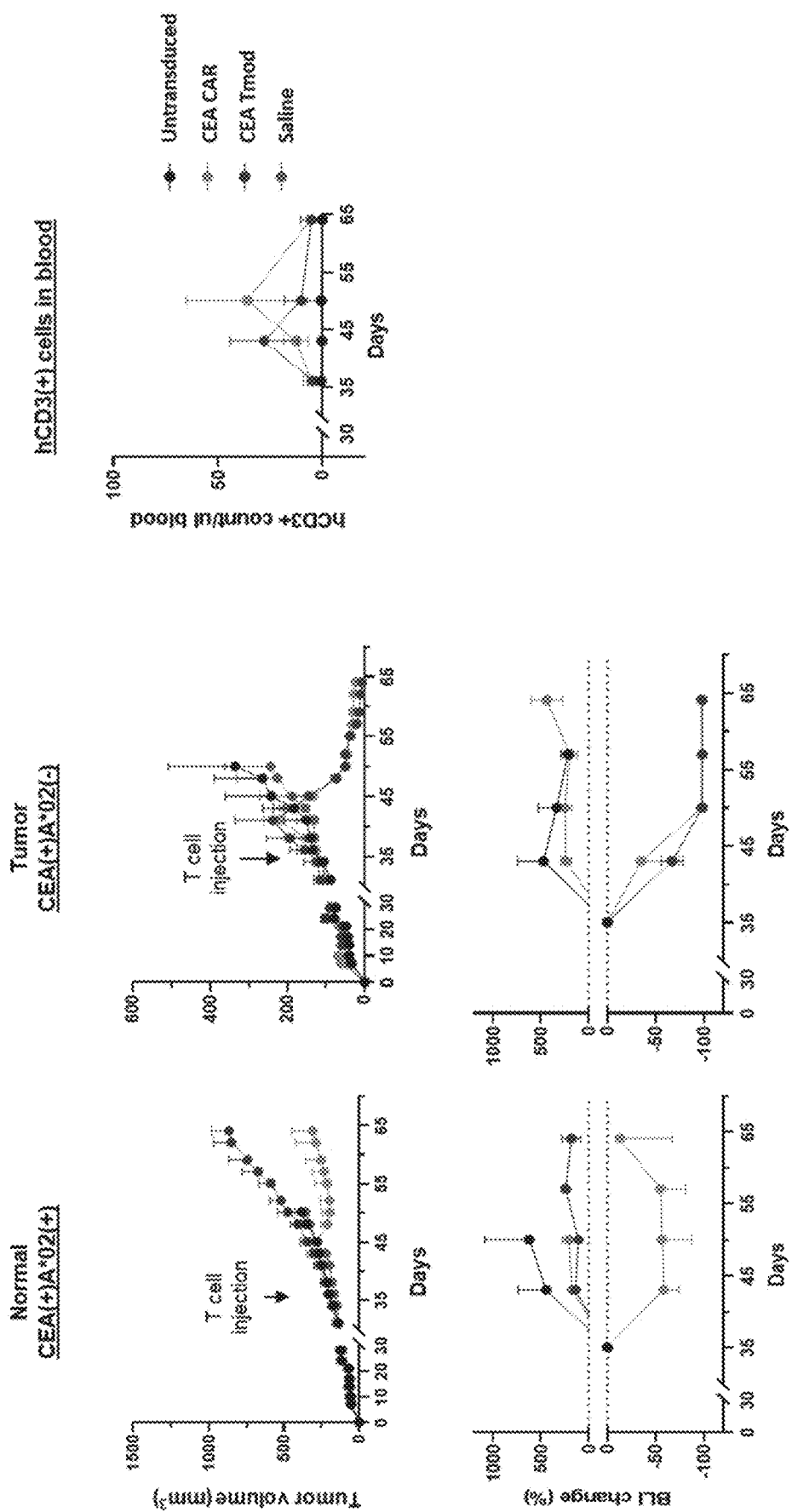
FIG. 40 shows tumor volume measured by caliper in the mouse xenograft study. Error bars are SEM. N=7 mice/group (5 in Saline and UTD, or untransduced, groups); xenograft=H508 colon cancer cell line that express firefly luciferase; dose=2E7 human T cells/mouse via tail vein injection. BLI % change=100× (BLI day t−BLI day 35)/(BLI day 35).−100% on the y-axis at the lower right indicates zero bioluminescence signal; i.e., no evidence of any residual tumor cells. Human T cells in mouse blood were detected with an hCD3 mAb.
Figure 41:
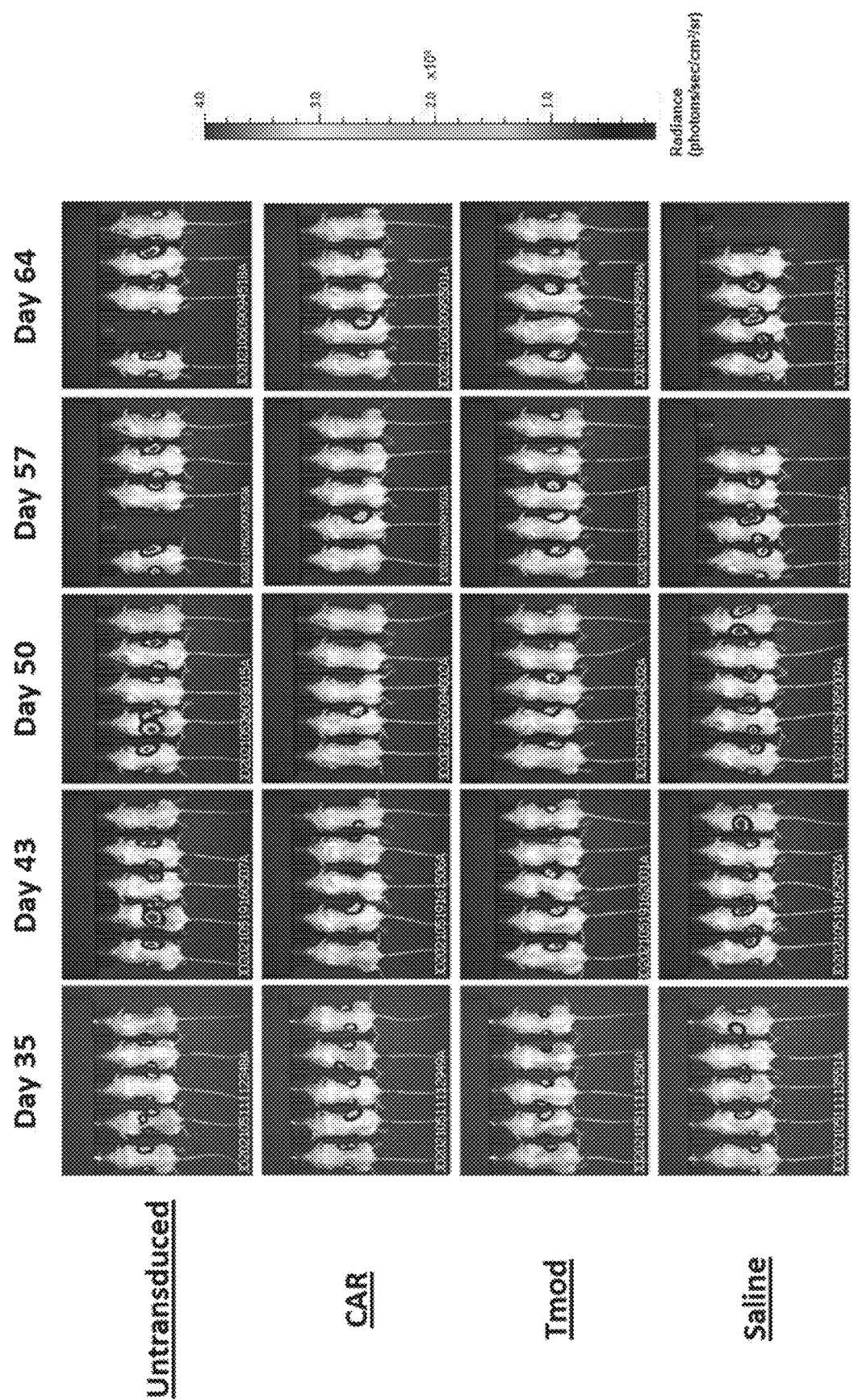
FIG. 41 shows images of five mice from each group (a subset of those in FIG. 40) which were used to measure bioluminescence (lucerifase) over time. One Tmod mouse ($2^{nd}$ from the left, day64) did not receive BLI substrate by mistake.
Figure 42:
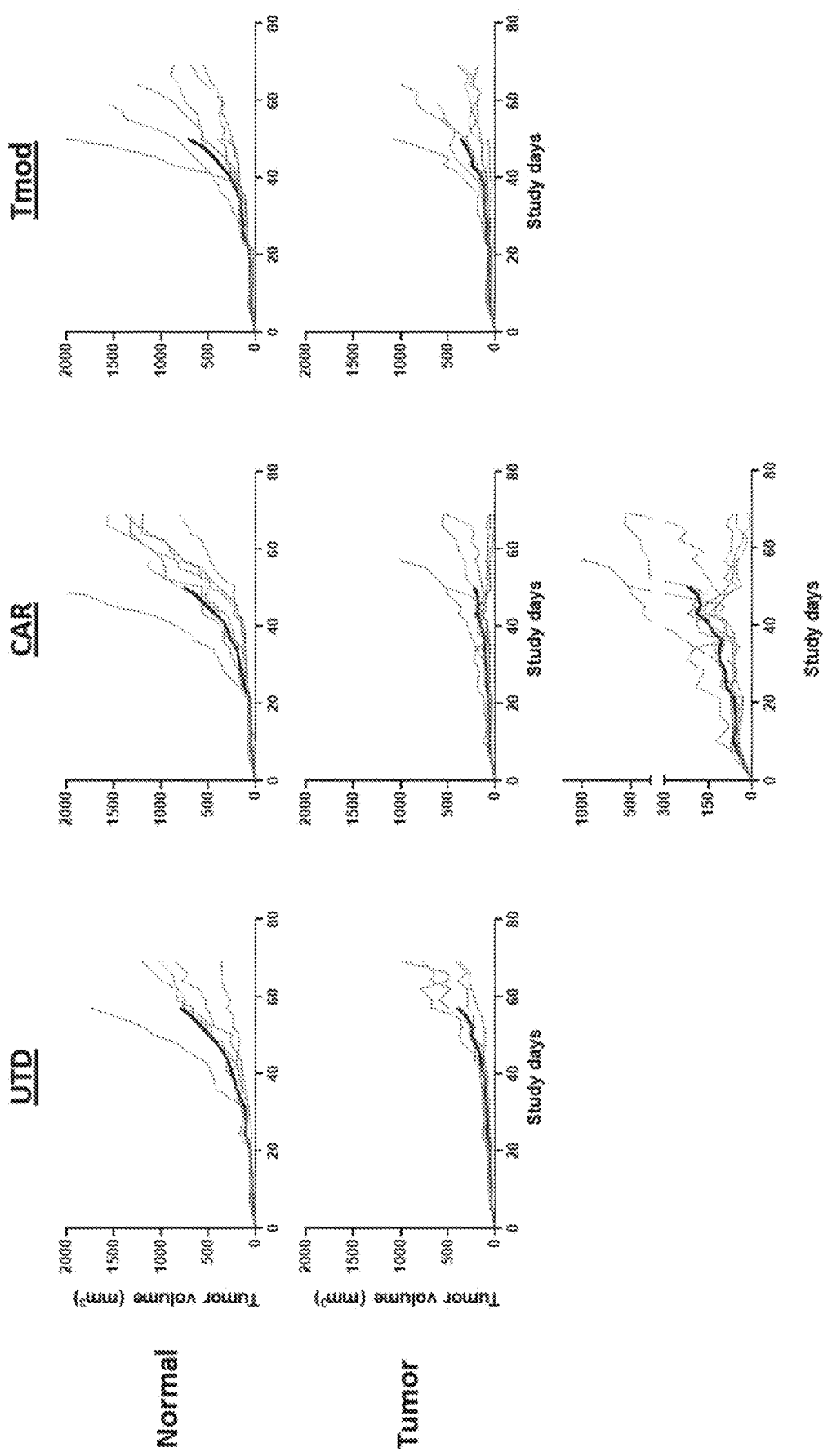
FIG. 42 shows xenograft study results for the T cell dose of 5E6 T cells per mouse. The center bottom panel shows replotted data from the panel above, to show tumor volumes at higher resolution. UTD: untransduced; CAR, T cell transduced with CEA CAR alone; Tmod, T cells transduced with CEA CAR and HLA-A*02 scFv LILRB1 inhibitory receptor.

The 5E6 dose demonstrated small and inconsistent effects for the CAR and Tmod constructs (FIG. 42). However, the 2E7 dose showed dramatic differences (FIGS. 40-41). In FIG. 40, 7 mice/group were used (except that 5 were in the saline and UTD, or untransduced, groups). The xenograft was from an H508 colon cancer cell line that was engineered to express firefly luciferase. Mice were injected with CEA CAR or CEA CAR Tmod dual receptor expressing cells at a dose of 2E7 human T cells per mouse via tail vein injection. Data points in FIG. 40 are shown for each cohort up to the time when individual mice in the cohort had large tumor volumes (>2000 mm³ total volume). One-direction error bars are used for some curves to avoid crowding. Error bars are standard error of the mean. All mice in the cohort injected with T cells expressing the Tmod dual receptors showed no tumor growth over ~20 additional days, suggesting a curative effect. One mouse in the CAR/normal graft cohort escaped and grew, causing the average to increase.

Figure 43:
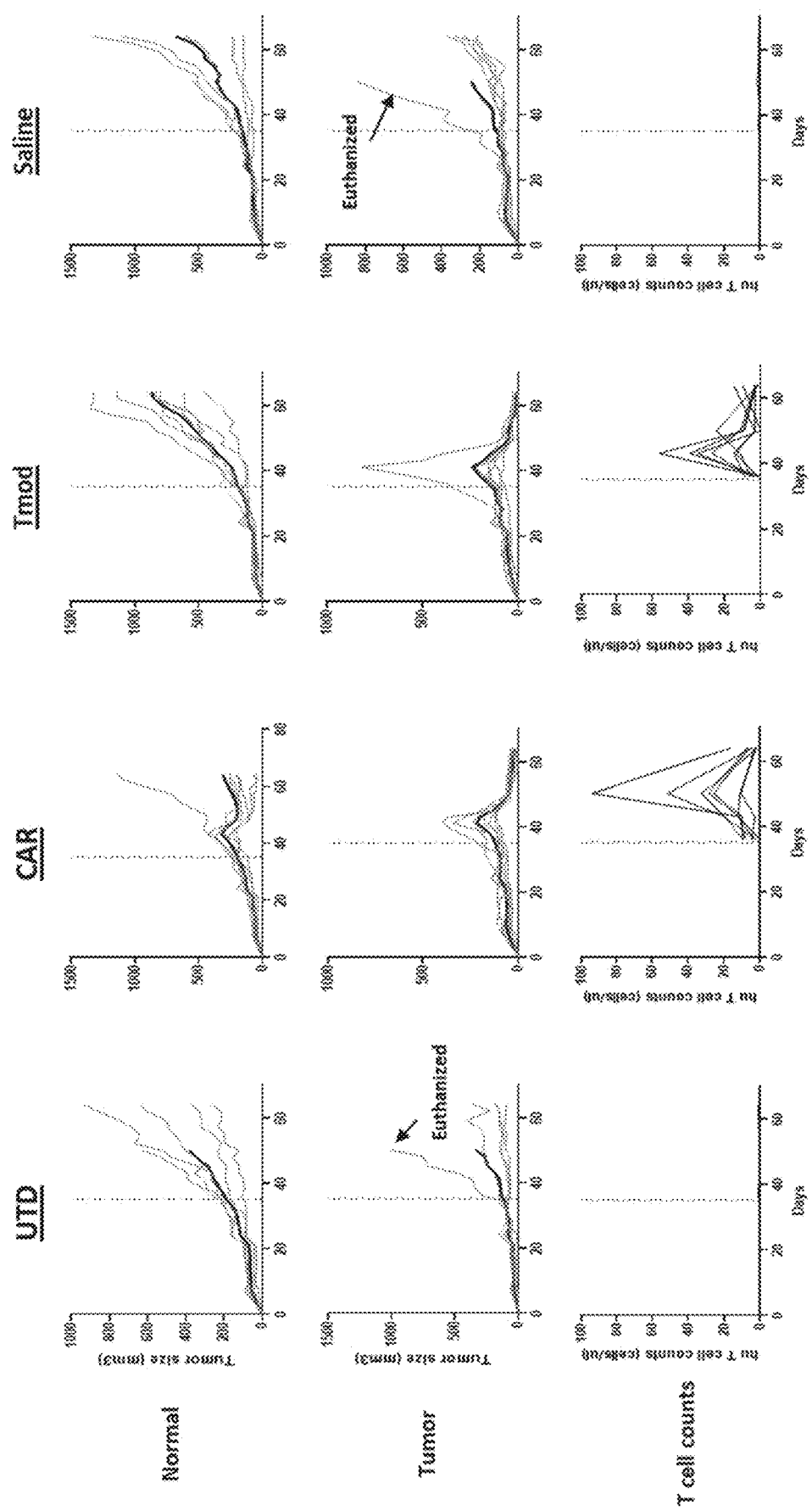
FIG. 43 shows individual tumor data from the mouse xenograft study. Light gray thin lines: individual mouse; black thick lines: average; dotted vertical line: T cell injection day (Day 35). UTD, untransduced T cells; CAR, T cells transduced with CEA CAR, Tmod, T cells transduced with both CEA CAR and HLA-A*02 ScFv LILRB1 inhibitory receptor; saline, mice injected with saline control.

FIGS. 42-43 for individual tumor data. As seen in FIG. 43, one CAR-T-treated animal, the tumor responded, but then resumed growth. This may be attributable to the larger tumor volume in that animal at T cell infusion. The normal grafts were slightly larger than the tumor grafts on average, and the CAR-T cells did not eradicate tumors completely. Both animals treated with cells expressing the CEA CAR and the CEA CAR in combination with the HLA-A*02 inhibitory receptor (Tmod cells) showed a reduction in CD3+ T cells. However, animals treated with the Tmod cells started to reduce the level of CD3+ T cells at an earlier time point. The reduction of T cell count at the end of the assay in the cohort injected with T cells expressing the Tmod dual receptors is likely attributable to the complete elimination of the tumor on one flank and the effective blocking of antigen by the graft on the other flank, resulting in the cessation of effective activator signaling.

Figure 44:
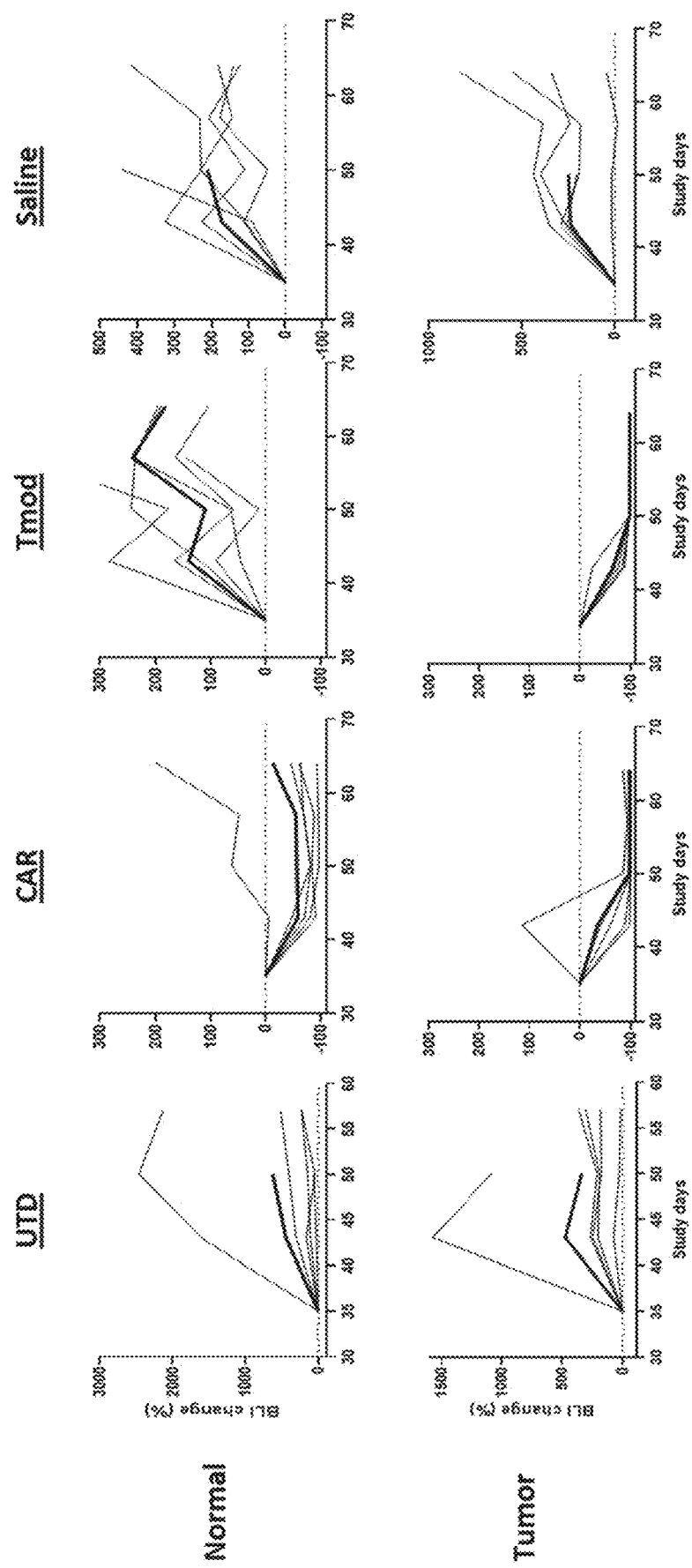
FIG. 44 shows bioluminescence (BLI) in individual mice in the xenograft study. % BLI was determined as described for FIG. 40. UTD, untransduced T cells; CAR, T cells transduced with CEA CAR, Tmod, T cells transduced with both CEA CAR and HLA-A*02 ScFv LILRB1 inhibitory receptor; saline, mice injected with saline control.

Whereas cells expressing the CEA CAR alone killed both tumor and normal grafts, the Tmod-engineered T cells only killed the HLA-A*02(−) tumor. Normal HLA-A*02 (+) H508 cells grew in the mice similar to saline-treated controls. The caliper measurements of tumor size were confirmed by bioluminescence, with no signal detected on the flanks of the Tmod-treated mice which had harbored tumors (FIGS. 40-41). For unknown reasons, the xenografts on the right flank were on average slightly larger than the tumors on the left flank. This resulted in a subtle apparent efficacy difference between the tumor and normal H508 cells treated by T cells expressing the CEA CAR and T cells expressing the Tmod dual receptors. CAR and Tmod treated mice showed very similar activity on the left flank. Although the Tmod T cell treated cohort appeared to be tumor-free, the CAR-T cohort had residual average tumor volume on the right flank bearing the normal graft, including one escaper that initially responded and then resumed growth (FIGS. 43-44). One tumor in the Tmod Tcell injected cohort was nearly 1 cc before being eliminated like the others in the cohort. These results suggest that CEA CAR Tmod T cells function in vivo in the same potent, tumor-selective manner as in vitro.

Figure 45:
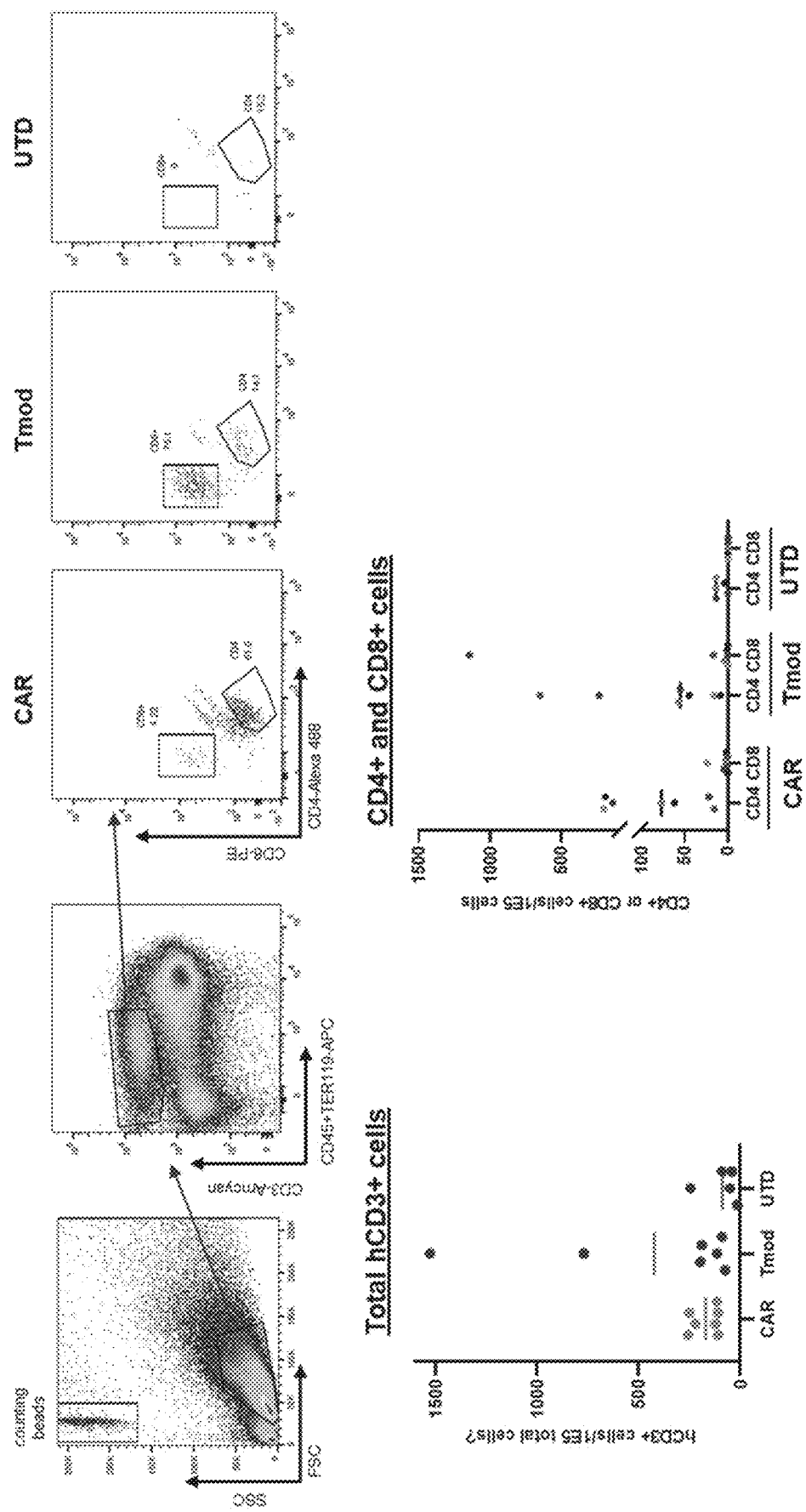
FIG. 45 shows cell analysis from spleens of mice from the xenograft study. Cells were harvested 30 days post T cell injection.

A variety of other parameters, including blood counts of the infused T cells were also measured. Two days post infusion, T cells from all cohorts were present at a level 1/10,000 of the concentration expected if they survived and remained in the blood (FIG. 40). However, in the cohorts treated with the CEA CAR and CEA CAR Tmod T cells, the T cell count increased over time. Ultimately the CEA CAR Tmod T cells declined, paralleling tumor elimination. The CAR-T cells remained longer, presumably because residual CEA(+) HLA-A*02(+) graft cells were present to provide antigen stimulation. By 30 days post infusion they had declined to baseline. In the Tmod T cell cohort, xenografts continued to grow on the right flank of the mice, but these expressed the HLA-A*02 blocker antigen, effectively preventing activator-antigen stimulation of the Tmod cells. Several other analyses were conducted on the cells, tissues and organs of the mice (FIG. 45). FIG. 45 shows that the majority of mice had higher CD4 counts than CD8 counts. The presence of CD3(+) human T cells was observed in spleens of two mice in the CEA Tmod group 30 days post T cell injection. The mice were generally healthy and maintained body weight similar to that of the saline and control untransduced T cell group.

Example 11: HLA-A*02 Cis Binding and Autologous Therapy

Figure 46:
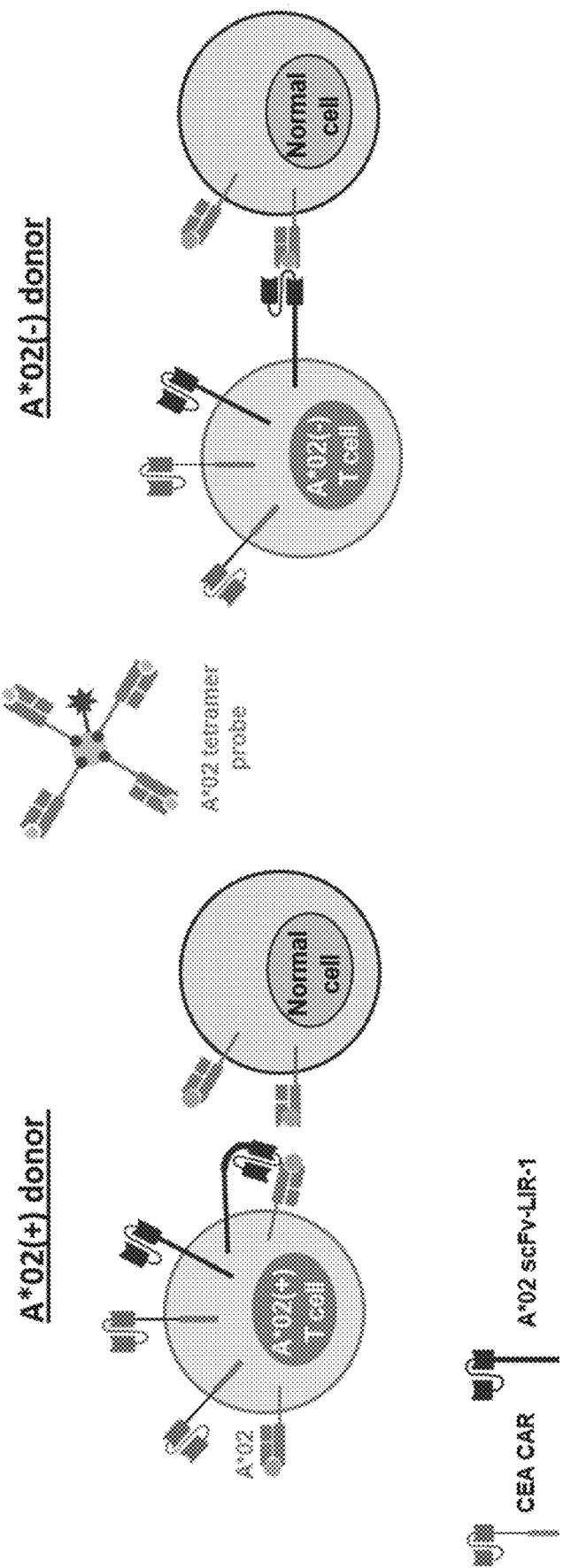
FIG. 46 is a diagram showing how HLA-A*02 antigen can bind to the HLA-A*02 Tmod blocker receptor in cis in HLA-A*02(+) T cells to hinder blocker receptor binding/function in trans with respect to normal cells. This effect can be detected via labeled HLA-A*02 tetramer and by functional assays.

An HLA-A*02 blocker receptor could in principle be impacted in cis by endogenous A*02 in autologous T cells (FIG. 46). Responses in parental Jurkat cells were therefore compared with a Jurkat line engineered to express HLA-A*02. Little difference was seen in blocker receptor surface expression level was detected between the HLA-A*02(+) transgenic Jurkat line compared to the wild-type HLA-A*02 (−) parental line (FIG. 50). The IC50 of the blocker was also similar in HLA-A*02(+) and HLA-A*02(−) Jurkat cells.

Figure 51:
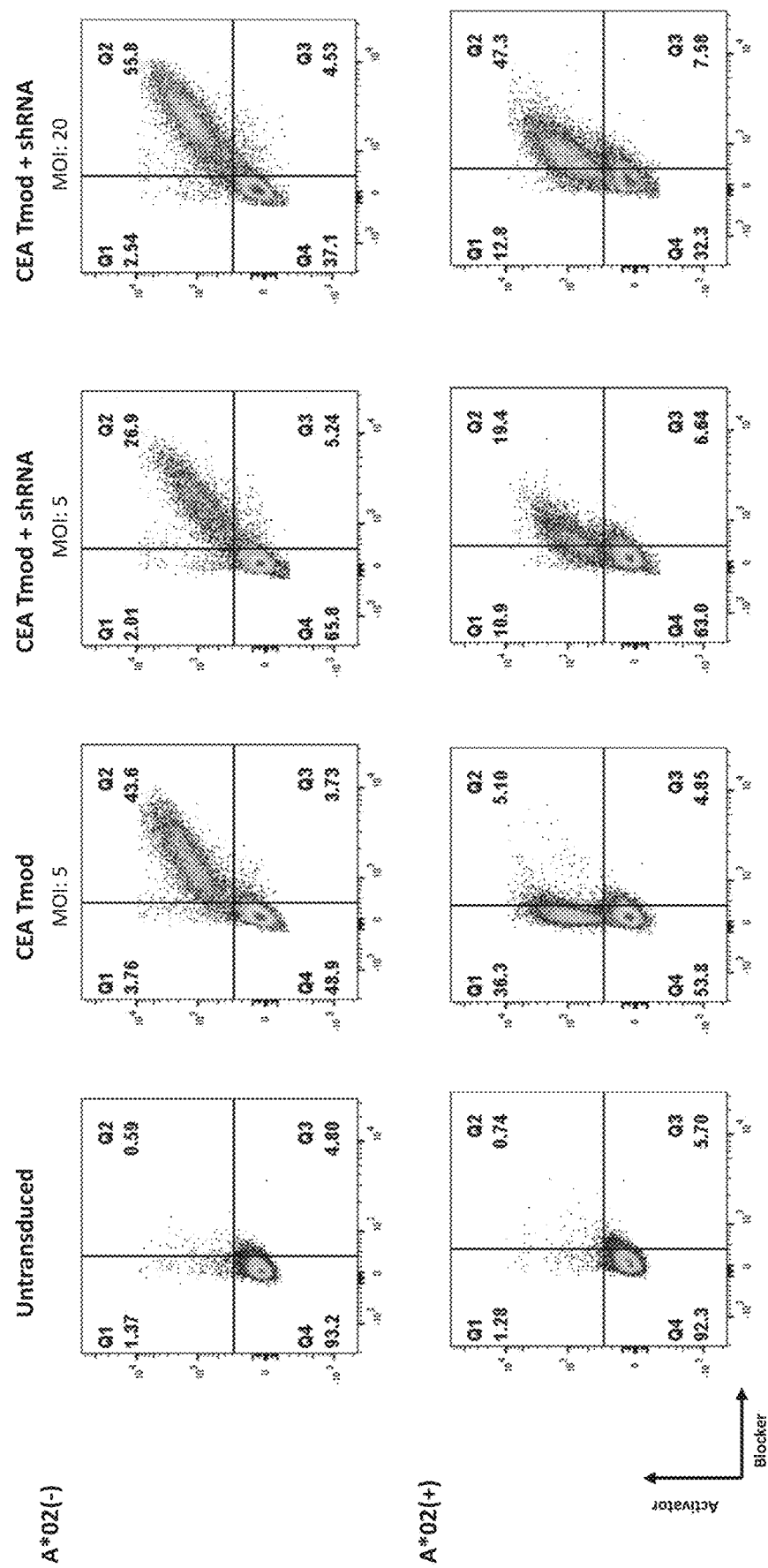
FIG. 51 shows that co-expression of a B2M shRNA in T cells expressing the HLA-A*02 scFv LILRB1 inhibitory receptor frees the receptor to bind probe on primary T cells.

However, results were different in primary T cells. T cells from HLA-A*02(+) donors expressed less blocker receptor on their surface compared to HLA-A*02(−) donors (FIG. 47). To address this difference, an shRNA module that targets B2M was developed. B2M is the common light chain of HLA class I molecules and is required for their expression on the cell surface. The HLA-A*02 tetramer binding difference between HLA-A*02(+) and HLA-A*02(−) donor cells transduced with CEA CAR Tmod receptors was substantially reduced, with binding levels close to those seen with CRISPR-treated T cells (FIGS. 47 and 51). As seen in FIG. 47, the B2M shRNA partially restored probe binding. B2M knockout via CRISPR/Cas9 similarly restored probe binding to the same level as seen in HLA-A*02(−) cells. HLA class I was detected by pan HLA-I mAb W6/32, and blocker receptor expression was detected by A*02 tetramer. Individual dots in FIG. 47 represent different donors. In total, 8 donors were used: 6 donors who were HLA-A*02(+) and 2 donors who were HLA-A*02(−). All were tested in triplicate and the average was plotted as a single dot. The group labeled Tmod_A2 neg contains data from the 2 HLA-A*02 (−) donors with the 3 conditions/constructs to its immediate left (Tmod only, Tmod+CRISPR, Tmod+shRNA plotted together). One T cell population from this experiment died and was excluded here and in FIG. 48.

Levels of B2M in T cells from three donors are shown in Table 27 below. Total RNA from 3 donors of untransduced T cells and Tmod transduced T cells (including the B2M shRNA) was extracted and reverse transcribed into complementary DNA. Droplet digital polymerase chain reaction reactions were set up to assess B2M expression levels in the untransduced T cells and A2B530. B2M mRNA expression level was normalized to beta actin gene expression.

TABLE 27

Relative mRNA Expression Level of B2M Between Tmod transduced and Untransduced T cells

| HLA-A*02(+) Donor | B2M Expression Level | |
|---|---|---|
| | UTD | Transduced with Tmod+ B2M shRNA |
| 1 | 100% | 34% ± 1.5% |
| 2 | 100% | 18% ± 1.1% |
| 3 | 100% | 24% ± 1.1% |

Figure 48:
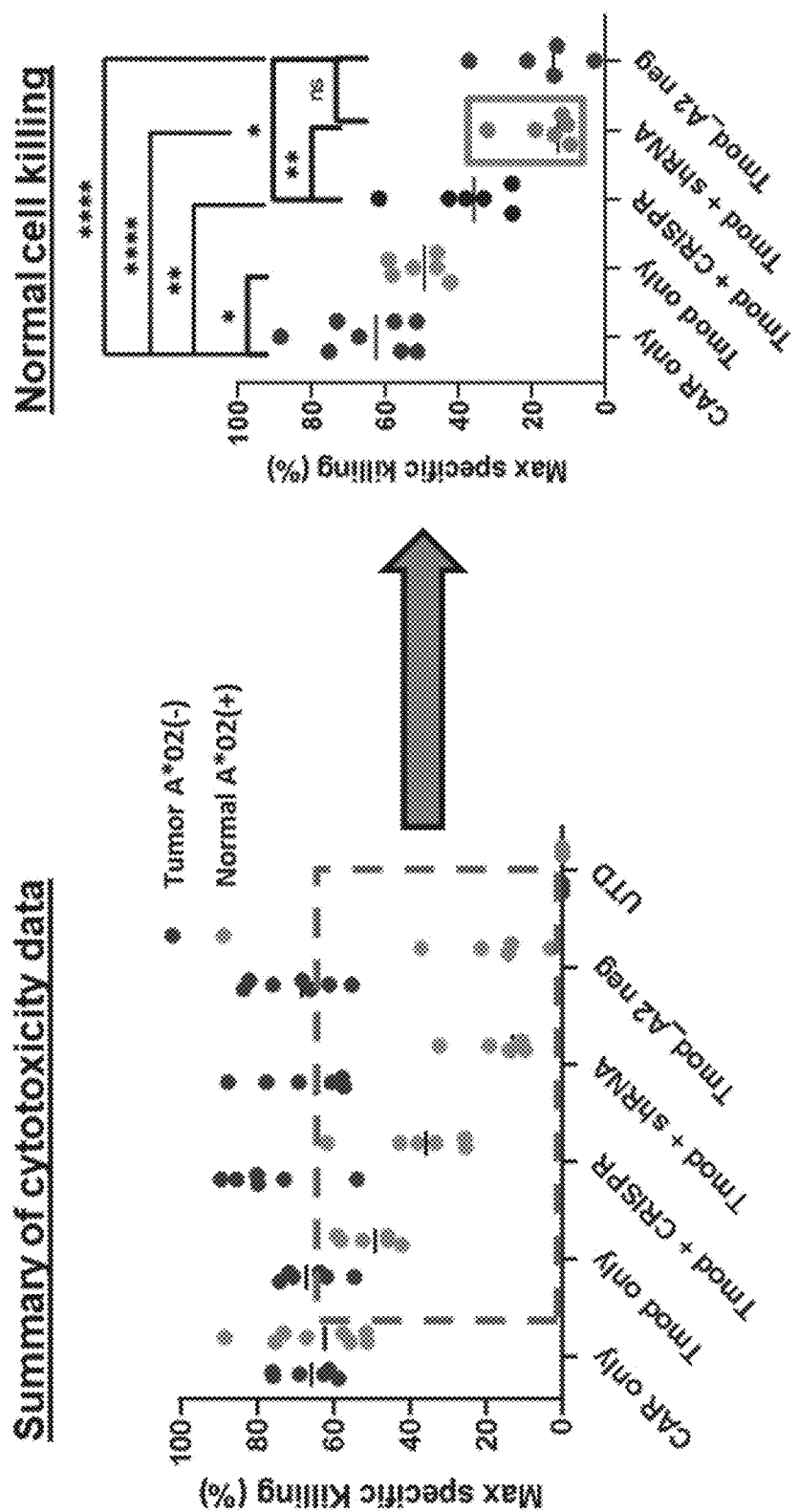
FIG. 48 shows the effect of a B2M shRNA construct on cis binding for the 1st generation autologous T cells expressing the CEA CAR and HLA-A*02 scFvLILRB1 inhibitory receptor (Tmod).
Figure 49:
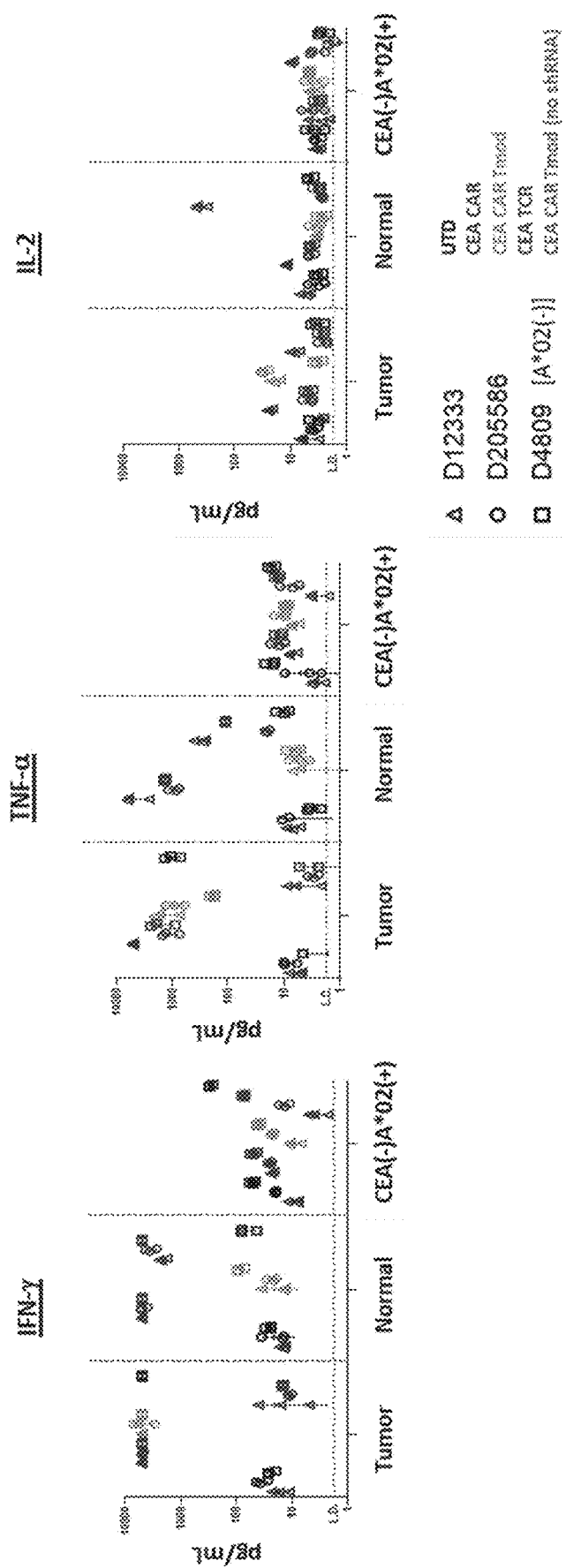
FIG. 49 shows cytokine secretion in acute cytotoxicity assays. Tumor cells were CEA(+) HLA-A*02(−) H508 cells; normal cells were CEA(+) HLA-A*02(+) H508 cells; L.D., limit of detection=background+3× standard deviation for each assay.
Figure 52:
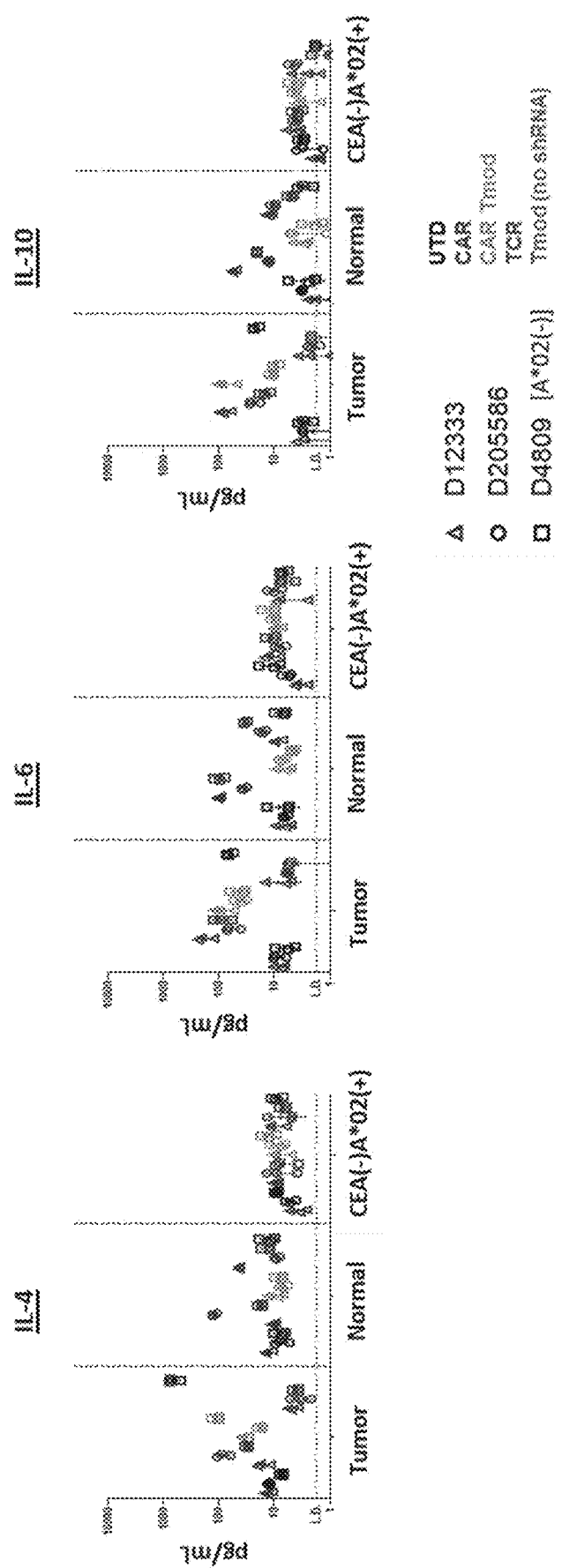
FIG. 52 shows cytokine secretion in acute cytotoxicity assays. Tumor, CEA(+) HLA-A*02(−) H508 cells; normal CEA(+) HLA-A*02(+) H508 cells; L.D., limit of detection=background+3× standard deviation for each assay.

In cytotoxicity assays using H508 target cells, the CEA CAR Tmod construct killed and blocked as effectively in A*02(+) donors (n=6) as in A*02(−) donors (n=2) (FIG. 48). These data correlated with cytokine release (FIGS. 49 and 52). Thus, the CEA CAR Tmod construct that contains a B2M shRNA module may be suitable as an autologous T cell therapy for a subset of A*02 heterozygous solid-tumor patients whose tumor contain HLA-A LOH.

In FIG. 48, the functions of Tmod with a B2M shRNA module in HLA-A*02(+) donors is indistinguishable from its function in HLA-A*02(−) donors. Normal indicates H508 target cells with native CEA and HLA-A*02 expression; while tumor indicates H508 target cells with HLA-A*02 deleted. The assay was carried out after 48 hours with an E:T of 3:1. The graph on the right contains only the normal target cell data replotted from the dashed-line box in the left graph.

In FIG. 49, cytokine expression from CEA CAR Tmod expressing cells was compared to CEA CAR expressing cells and cells expressing the benchmark TCR. Donors D123333 and D205586 were HLA-A*02(+), while donor D4809 was HLA-A*02(−). This dataset included and a test of the CEA Tmod receptors with and without the B2M shRNA. The IFN-g assay saturated at 10K pg/mL.

Additional cytokines are shown in FIG. 52. Cells expressing the CEA CAR Tmod receptors were compared against CEA CAR expressing cells and cells expressing the benchmark TCR. Donors 1 and 2 were HLA-A*02(+); donor 3 was HLA-A*02(−). The data includes a test of the CEA Tmod receptors without a B2M shRNA.

SEQUENCE LISTING (984 sequences)

SEQ ID NO: 1 - protein, 702 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 2 - protein, 9 aa, Homo sapiens
IMIGVLVGV

SEQ ID NO: 3 - protein, 5 aa, Artificial Sequence
  anti-MHC-I HLA-A*02 + CEA (IMIGVLVGV) A-CDR1
TSITA

SEQ ID NO: 4 - protein, 6 aa, Artificial Sequence
  anti-MHC-I HLA-A*02 + CEA (IMIGVLVGV) A-CDR2
IRSNER

SEQ ID NO: 5 - protein, 11 aa, Artificial Sequence
  anti-MHC-I HLA-A*02 + CEA (IMIGVLVGV) A-CDR3
ATDLTSGGNYK

SEQ ID NO: 6 - protein, 11 aa, Artificial Sequence
  anti-MHC-I HLA-A*02 + CEA (IMIGVLVGV) A-CDR3
ATDFTSGGNYK

SEQ ID NO: 7 - protein, 11 aa, Artificial Sequence
  anti-MHC-I HLA-A*02 + CEA (IMIGVLVGV) A-CDR3
ATDLTTGGNYK

SEQ ID NO: 8 - protein, 11 aa, Artificial Sequence
  anti-MHC-I HLA-A*02 + CEA (IMIGVLVGV) A-CDR3
ATDFTTGGNYK

SEQ ID NO: 9 - protein, 5 aa, Artificial Sequence
  anti-MHC-I HLA-A*02 + CEA (IMIGVLVGV) B-CDR1
KGHPV

SEQ ID NO: 10 - protein, 6 aa, Artificial Sequence
  anti-MHC-I HLA-A*02 + CEA (IMIGVLVGV) B-CDR2
FQNQEV

SEQ ID NO: 11 - protein, 11 aa, Artificial Sequence
  anti-MHC-I HLA-A*02 + CEA (IMIGVLVGV) B-CDR3
ASSLGLGDYEQ

SEQ ID NO: 12 - protein, 11 aa, Artificial Sequence
  anti-MHC-I HLA-A*02 + CEA (IMIGVLVGV) B-CDR3
ASSLGTGDYEQ

SEQ ID NO: 13 - protein, 616 aa, Homo sapiens
MAPRARRRRPLFALLLLCALLARLQVALQIAPPCTSEKHYEHLGRCCNKCEPGKYMSSKCTTTSDSVCLPCGPDEYLDSWNEEDKCLLHKVCDTGKALVAVVAGNSTTPRRCACTAGYHWSQDCECCRRNTECAPGLGAQHPLQLNKDTVCKPCLAGYFSDAFSSTDKCRPWTNCTFLGKRVEHHGTEKSDAVCSSSLPARKPPNEPHVYLPGLIILLLFASVALVAAIIFGVCYRKKGKALTANLWHWINEACGRLSGDKESSGDSCVSTHTANFGQQGACEGVLLLTLEEKTFPEDMCYPDQGGVCQGTCVGGGPYAQGEDARMLSLVSKTEIEEDSFRQMPTEDEYMDRPSQPTDQLLFLTEPGSKSTPPFSEPLEVGENDSLSQCFTGTQSTVGSESCNCTEPLCRTDWTPMSSENYLQKEVDSGHCPHWAASPSPNWADVCTGCRNPPGEDCEPLVGSPKRGPLPQCAYGMGLPPEEEASRTEARDQPEDGADGRLPSSARAGAGSGSSPGGQSPASGNVTGNSNSTFISSGQVMNFKGDIIVVYVSQTSQEGAAAAAEPMGRPVQEETLARRDSFAGNGPRFPDPCGGPEGLREPEKASRPVQEQGGAKA

SEQ ID NO: 14 - protein, 1179 aa, Homo sapiens
MWLFHTLLCIASLALLAAFNVDVARPWLTPKGGAPFVLSSLLHQDPSTNQTWLLVTSPRTKRTPGPLHRCSLVQDEILCHPVEHVPIPKGRHRGVTVVRSHHGVLICIQVLVRRPHSLSSELTGTCSLLGPDLRPQAQANFFDLENLLDPDARVDTGDCYSNKEGGGEDDVNTARQRRALEKEEEEDKEEEEDEEEEEAGTEIAIILDGSGSIDPPDFQRAKDFISNMMRNFYEKCFECNFALVQYGGVIQTEFDLRDSQDVMASLARVQNITQVGSVTKTASAMQHVLDSIFTSSHGSRRKASKVMVVLTDGGIFEDPLNLTTVINSPKMQGVERFAIGVGEEFKSARTARELNLIASDPDETHAFKVTNYMALDGLLSKLRYNIISMEGTVGDALHYQLAQIGFSAQILDERQVLLGAVGAFDWSGGALLYDTRSRRGRFLNQTAAAAADAEAAQYSYLGYAVAVLHKTCSLSYIAGAPRYKHHGAVFELQKEGREASFLPVLEGEQMGSYFGSELCPVDIDMDGSTDFLLVAAPFYHVHGEEGRVYVYRLSEQDGSFSLARILSGHPGFTNARFGFAMAAMGDLSQDKLTDVAIGAPLEGFGADDGASFGSVYIYNGHWDGLSASPSQRIRASTVAPGLQYFGMSMAGGFDISGDGLADITVGTLGQAVVFRSRPVVRLKVSMAFTPSALPIGFNGVVNVRLCFEISSVTTASESGLREALLNFTLDVDVGKQRRRLQCSDVRSCLGCLREWSSGSQLCEDLLLMPTEGELCEEDCFSNASVKVSYQLQTPEGQTDHPQPILDRYTEPFAIFQLPYEKACKNKLFCVAELQLATTVSQQELVVGLTKELTLNINLTNSGEDSYMTSMALNYPRNLQLKRMQKPPSPNIQCDDPQPVASVLIMNCRIGHPVLKRSSAHVSVVWQLEENAFPNRTADITVTVTNSNERRSLANETHTLQFRHGFVAVLSKPSIMYVNTGQGLSHHKEFLFHVHGENLFGAEYQLQICVPTKLRGLQVVAVKKLTRTQASTVCTWSQERACAYSSVQHVEEWHSVSCVIASDKENVTVAAEISWDHSEELLKDVTELQILGEISFNKSLYEGLNAENHRTKITVVFLKDEKYHSLPIIIKGSVGGLLVLIVILVILFKCGFFKRKYQQLNLESIRKAQLKSENLLEEEN

SEQ ID NO: 15 - protein, 701 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 16 - protein, 598 aa, Artificial Sequence
  CT 548: pLenti 1 CEA TCR TRAV8-1*01 118P & 119T with murine constant region
MHSLLGLLMVSLWLQLTRVNSQLAEENPWALSVHEGESVTVNCSYKTSITALQWYRQKSGEGPAQLILIRSNEREKRNGRLRATLDTSSQSSSLSITATRCEDTAVYFCATDLTSGGNYKPTFGKGTSLVVHPDIQNPEPAVYQLKDPRSQDSTLCLFTDFDSQINVPKTMESGTFITDKTVLDMKAMDSKSNGAIAWSNQTSFTCQDIFKETNATYPSSDVPCDATLTEKSFETDMNLNFQNLSVMGLRILLLKVAGFNLLMTLRLWSSGSGATNFSLLKQAGDVEENPGPMATRLLCYTVLCLLGARILNSKVIQTPRYLVKGQGQKAKMRCIPEKGHPVVFWYQQNKNNEFKFLINFQNQEVLQQIDMTEKRFSAECPSNSPCSLEIQSSEAGDSALYLCASSLGLGDYEQYFGPGTRLTVLEDLRNVTPPKVSLFEPSKAEIANKQKATLVCLARGFFPDHVELSWWVNGKEVHSGVSTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 17 - protein, 598 aa, Artificial Sequence
  CT 549: pLenti 1 CEA TCR TRAV8-1*01 118P & 119T TRBV26*01 L117T with murine constant region
MHSLLGLLMVSLWLQLTRVNSQLAEENPWALSVHEGESVTVNCSYKTSITALQWYRQKSGEGPAQLILIRSNEREKRNGRLRATLDTSSQSSSLSITATRCEDTAVYFCATDLTSGGNYKPTFGKGTSLVVHPDIQNPEPAVYQLKDPRSQDSTLCLFTDFDSQINVPKTMESGTFITDKTVLDMKAMDSKSNGAIAWSNQTSFTCQDIFKETNATYPSSDVPCDATLTEKSFETDMNLNFQNLSVMGLRILLLKVAGFNLLMTLRLWSSGSGATNFSLLKQAGDVEENPGPMATRLLCYTVLCLLGARILNSKVIQTPRYLVKGQGQKAKMRCIPEKGHPVVFWYQQNKNNEFKFLINFQNQEVLQQIDMTEKRFSAECPSNSPCSLEIQSSEAGDSALYLCASSLGTGDYEQYFGPGTRLTVLEDLRNVTPPKVSLFEPSKAEIANKQKATLVCLARGFFPDHVELSWWVNGKEVHSGVSTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 18 - protein, 598 aa, Artificial Sequence
  CT 550: pLenti 1 CEA TCR TRAV8-1*01 118P & 119T with murine constant region
MHSLLGLLMVSLWLQLTRVNSQLAEENPWALSVHEGESVTVNCSYKTSITALQWYRQKSGEGPAQLILIRSNEREKRNGRLRATLDTSSQSSSLSITATRCEDTAVYFCATDLTSGGNYKPTFGKGTSLVVHPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSGSGATNFSLLKQAGDVEENPGPMATRLLCYTVLCLLGARILNSKVIQTPRYLVKGQGQKAKMRCIPEKGHPVVFWYQQNKNNEFKFLINFQNQEVLQQIDMTEKRFSAECPSNSPCSLEIQSSEAGDSALYLCASSLGLGDYEQYFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 19 - protein, 598 aa, Artificial Sequence
  CT 551: pLenti 1 CEA TCR TRAV8-1*01 L110F 118P & 119T with murine constant region
MHSLLGLLMVSLWLQLTRVNSQLAEENPWALSVHEGESVTVNCSYKTSITALQWYRQKSGEGPAQLILIRSNEREKRNGRLRATLDTSSQSSSLSITATRCEDTAVYFCATDFTSGGNYKPTFGKGTSLVVHPDIQNPEPAVYQLKDPRSQDSTLCLFTDFDSQINVPKTMESGTFITDKTVLDMKAMDSKSNGAIAWSNQTSFTCQDIFKETNATYPSSDVPCDATLTEKSFETDMNLNFQNLSVMGLRILLLKVAGFNLLMTLRLWSSGSGATNFSLLKQAGDVEENPGPMATRLLCYTVLCLLGARILNSKVIQTPRYLVKGQGQKAKMRCIPEKGHPVVFWYQQNKNNEFKFLINFQNQEVLQQIDMTEKRFSAECPSNSPCSLEIQSSEAGDSALYLCASSLGLGDYEQYFGPGTRLTVLEDLRNVTPPKVSLFEPSKAEIANKQKATLVCLARGFFPDHVELSWWVNGKEVHSGVSTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 20 - protein, 598 aa, Artificial Sequence
  CT 552: pLenti 1 CEA TCR TRAV8-1*01 S112T 118P & 119T with murine constant region
MHSLLGLLMVSLWLQLTRVNSQLAEENPWALSVHEGESVTVNCSYKTSITALQWYRQKSGEGPAQLILIRSNEREKRNGRLRATLDTSSQSSSLSITATRCEDTAVYFCATDLTTGGNYKPTFGKGTSLVVHPDIQNPEPAVYQLKDPRSQDSTLCLFTDFDSQINVPKTMESGTFITDKTVLDMKAMDSKSNGAIAWSNQTSFTCQDIFKETNATYPSSDVPCDATLTEKSFETDMNLNFQNLSVMGLRILLLKVAGFNLLMTLRLWSSGSGATNFSLLKQAGDVEENPGPMATRLLCYTVLCLLGARILNSKVIQTPRYLVKGQGQKAKMRCIPEKGHPVVFWYQQNKNNEFKFLINFQNQEVLQQIDMTEKRFSAECPSNSPCSLEIQSSEAGDSALYLCASSLGLGDYEQYFGPGTRLTVLEDLRNVTPPKVSLFEPSKAEIANKQKATLVCLARGFFPDHVELSWWVNGKEVHSGVSTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 21 - protein, 598 aa, Artificial Sequence
  CT 553: pLenti 1 CEA TCR TRAV8-1*01 L110F S112T 118P & 119T with murine constant region
MHSLLGLLMVSLWLQLTRVNSQLAEENPWALSVHEGESVTVNCSYKTSITALQWYRQKSGEGPAQLILIRSNEREKRNGRLRATLDTSSQSSSLSITATRCEDTAVYFCATDFTTGGNYKPTFGKGTSLVVHPDIQNPEPAVYQLKDPRSQDSTLCLFTDFDSQINVPKTMESGTFITDKTVLDMKAMDSKSNGAIAWSNQTSFTCQDIFKETNATYPSSDVPCDATLTEKSFETDMNLNFQNLSVMGLRILLLKVAGFNLLMTLRLWSSGSGATNFSLLKQAGDVEENPGPMATRLLCYTVLCLLGARILNSKVIQTPRYLVKGQGQKAKMRCIPEKGHPVVFWYQQNKNNEFKFLINFQNQEVLQQIDMTEKRFSAECPSNSPCSLEIQSSEAGDSALYLCASSLGLGDYEQYFGPGTRLTVLEDLRNVTPPKVSLFEPSKAEIANKQKATLVCLARGFFPDHVELSWWVNGKEVHSGVSTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 22 - protein, 598 aa, Artificial Sequence
  CT 554: pLenti 1 CEA TCR TRAV8-1*01 L110F 118P & 119T TRBV26*01 L117T with murine constant region
MHSLLGLLMVSLWLQLTRVNSQLAEENPWALSVHEGESVTVNCSYKTSITALQWYRQKSGEGPAQLILIRSNEREKRNGRLRATLDTSSQSSSLSITATRCEDTAVYFCATDFTSGGNYKPTFGKGTSLVVHPDIQNPEPAVYQLKDPRSQDSTLCLFTDFDSQINVPKTMESGTFITDKTVLDMKAMDSKSNGAIAWSNQTSFTCQDIFKETNATYPSSDVPCDATLTEKSFETDMNLNFQNLSVMGLRILLLKVAGFNLLMTLRLWSSGSGATNFSLLKQAGDVEENPGPMATRLLCYTVLCLLGARILNSKVIQTPRYLVKGQGQKAKMRCIPEKGHPVVFWYQQNKNNEFKFLINFQNQEVLQQIDMTEKRFSAECPSNSPCSLEIQSSEAGDSALYLCASSLGTGDYEQYFGPGTRLTVLEDLRNVTPPKVSLFEPSKAEIANKQKATLVCLARGFFPDHVELSWWVNGKEVHSGVSTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 23 - protein, 598 aa, Artificial Sequence
  CT 555: pLenti 1 CEA TCR TRAV8-1*01 S112T 118P & 119T TRBV26*01 L117T with murine constant region
MHSLLGLLMVSLWLQLTRVNSQLAEENPWALSVHEGESVTVNCSYKTSITALQWYRQKSGEGPAQLILIRSNEREKRNGRLRATLDTSSQSSSLSITATRCEDTAVYFCATDLTTGGNYKPTFGKGTSLVVHPDIQNPEPAVYQLKDPRSQDSTLCLFTDFDSQINVPKTMESGTFITDKTVLDMKAMDSKSNGAIAWSNQTSFTCQDIFKETNATYPSSDVPCDATLTEKSFETDMNLNFQNLSVMGLRILLLKVAGFNLLMTLRLWSSGSGATNFSLLKQAGDVEENPGPMATRLLCYTVLCLLGARILNSKVIQTPRYLVKGQGQKAKMRCIPEKGHPVVFWYQQNKNNEFKFLINFQNQEVLQQIDMTEKRFSAECPSNSPCSLEIQSSEAGDSALYLCASSLGTGDYEQYFGPGTRLTVLEDLRNVTPPKVSLFEPSKAEIANKQKATLVCLARGFFPDHVELSWWVNGKEVHSGVSTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 24 - protein, 598 aa, Artificial Sequence
  CT 556: pLenti 1 CEA TCR TRAV8-1*01 L110F S112T 118P & 119T TRBV26*01 L117T with murine constant region
MHSLLGLLMVSLWLQLTRVNSQLAEENPWALSVHEGESVTVNCSYKTSITALQWYRQKSGEGPAQLILIRSNEREKRNGRLRATLDTSSQSSSLSITATRCEDTAVYFCATDFTTGGNYKPTFGKGTSLVVHPDIQNPEPAVYQLKDPRSQDSTLCLFTDFDSQINVPKTMESGTFITDKTVLDMKAMDSKSNGAIAWSNQTSFTCQDIFKETNATYPSSDVPCDATLTEKSFETDMNLNFQNLSVMGLRILLLKVAGFNLLMTLRLWSSGSGATNFSLLKQAGDVEENPGPMATRLLCYTVLCLLGARILNSKVIQTPRYLVKGQGQKAKMRCIPEKGHPVVFWYQQNKNNEFKFLINFQNQEVLQQIDMTEKRFSAECPSNSPCSLEIQSSEAGDSALYLCASSLGTGDYEQYFGPGTRLTVLEDLRNVTPPKVSLFEPSKAEIANKQKATLVCLARGFFPDHVELSWWVNGKEVHSGVSTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 25 - protein, 598 aa, Artificial Sequence
  CT 557: pLenti 1 CEA TCR TRAV8-1*01 L110F 118P & 119T with murine constant region
MHSLLGLLMVSLWLQLTRVNSQLAEENPWALSVHEGESVTVNCSYKTSITALQWYRQKSGEGPAQLILIRSNEREKRNGRLRATLDTSSQSSSLSITATRCEDTAVYFCATDFTSGGNYKPTFGKGTSLVVHPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSGSGATNFSLLKQAGDVEENPGPMATRLLCYTVLCLLGARILNSKVIQTPRYLVKGQGQKAKMRCIPEKGHPVVFWYQQNKNNEFKFLINFQNQEVLQQIDMTEKRFSAECPSNSPCSLEIQSSEAGDSALYLCASSLGLGDYEQYFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 26 - protein, 598 aa, Artificial Sequence
  CT 558: pLenti 1 CEA TCR TRAV8-1*01 S112T 118P & 119T with murine constant region
MHSLLGLLMVSLWLQLTRVNSQLAEENPWALSVHEGESVTVNCSYKTSITALQWYRQKSGEGPAQLILIRSNEREKRNGRLRATLDTSSQSSSLSITATRCEDTAVYFCATDLTTGGNYKPTFGKGTSLVVHPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSGSGATNFSLLKQAGDVEENPGPMATRLLCYTVLCLLGARILNSKVIQTPRYLVKGQGQKAKMRCIPEKGHPVVFWYQQNKNNEFKFLINFQNQEVLQQIDMTEKRFSAECPSNSPCSLEIQSSEAGDSALYLCASSLGLGDYEQYFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 27 - protein, 598 aa, Artificial Sequence
  CT 559: pLenti 1 CEA TCR TRAV8-1*01 L110F S112T 118P & 119T with murine constant region
MHSLLGLLMVSLWLQLTRVNSQLAEENPWALSVHEGESVTVNCSYKTSITALQWYRQKSGEGPAQLILIRSNEREKRNGRLRATLDTSSQSSSLSITATRCEDTAVYFCATDFTTGGNYKPTFGKGTSLVVHPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSGSGATNFSLLKQAGDVEENPGPMATRLLCYTVLCLLGARILNSKVIQTPRYLVKGQGQKAKMRCIPEKGHPVVFWYQQNKNNEFKFLINFQNQEVLQQIDMTEKRFSAECPSNSPCSLEIQSSEAGDSALYLCASSLGLGDYEQYFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 28 - protein, 598 aa, Artificial Sequence
  CT 560: pLenti 1 CEA TCR TRAV8-1*01 118P & 119T TRBV26*01 L117T with murine constant region
MHSLLGLLMVSLWLQLTRVNSQLAEENPWALSVHEGESVTVNCSYKTSITALQWYRQKSGEGPAQLILIRSNEREKRNGRLRATLDTSSQSSSLSITATRCEDTAVYFCATDLTSGGNYKPTFGKGTSLVVHPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSGSGATNFSLLKQAGDVEENPGPMATRLLCYTVLCLLGARILNSKVIQTPRYLVKGQGQKAKMRCIPEKGHPVVFWYQQNKNNEFKFLINFQNQEVLQQIDMTEKRFSAECPSNSPCSLEIQSSEAGDSALYLCASSLGTGDYEQYFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 29 - protein, 598 aa, Artificial Sequence
  CT 561: pLenti 1 CEA TCR TRAV8-1*01 L110F 118P & 119T TRBV26*01 L117T with murine constant region
MHSLLGLLMVSLWLQLTRVNSQLAEENPWALSVHEGESVTVNCSYKTSITALQWYRQKSGEGPAQLILIRSNEREKRNGRLRATLDTSSQSSSLSITATRCEDTAVYFCATDLTTGGNYKPTFGKGTSLVVHPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSGSGATNFSLLKQAGDVEENPGPMATRLLCYTVLCLLGARILNSKVIQTPRYLVKGQGQKAKMRCIPEKGHPVVFWYQQNKNNEFKFLINFQNQEVLQQIDMTEKRFSAECPSNSPCSLEIQSSEAGDSALYLCASSLGTGDYEQYFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 30 - protein, 598 aa, Artificial Sequence; identical to SEQ ID NO: 29
  CT 562: pLenti 1 CEA TCR TRAV8-1*01 S112T 118P & 119T TRBV26*01 L117T with murine constant region

SEQ ID NO: 31 - protein, 598 aa, Artificial Sequence
  CT 563: pLenti 1 CEA TCR TRAV8-1*01 L110F S112T 118P & 119T TRBV26*01 L117T with murine constant region
MHSLLGLLMVSLWLQLTRVNSQLAEENPWALSVHEGESVTVNCSYKTSITALQWYRQKSGEGPAQLILIRSNEREKRNGRLRATLDTSSQSSSLSITATRCEDTAVYFCATDFTTGGNYKPTFGKGTSLVVHPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSGSGATNFSLLKQAGDVEENPGPMATRLLCYTVLCLLGARILNSKVIQTPRYLVKGQGQKAKMRCIPEKGHPVVFWYQQNKNNEFKFLINFQNQEVLQQIDMTEKRFSAECPSNSPCSLEIQSSEAGDSALYLCASSLGTGDYEQYFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 32 - protein, 625 aa, Mus musculus
MAPRARRRRQLPAPLLALCVLLVPLQVTLQVTPPCTQERHYEHLGRCCSRCEPGKYLSSKCTPTSDSVCLPCGPDEYLDTWNEEDKCLLHKVCDAGKALVAVDPGNHTAPRRCACTAGYHWNSDCECCRRNTECAPGFGAQHPLQLNKDTVCTPCLLGFFSDVFSSTDKCKPWTNCTLLGKLEAHQGTTESDVVCSSSMTLRRPPKEAQAYLPSLIVLLLFISVVVVAAIIFGVYYRKGGKALTANLWNWVNDACSSLSGNKESSGDRCAGSHSATSSQQEVCEGILLMTREEKMVPEDGAGVCGPVCAAGGPWAEVRDSRTFTLVSEVETQGDLSRKIPTEDEYTDRPSQPSTGSLLLIQQGSKSIPPFQEPLEVGENDSLSQCFTGTESTVDSEGCDFTEPPSRTDSMPVSPEKHLTKEIEGDSCLPWVVSSNSTDGYTGSGNTPGEDHEPFPGSLKCGPLPQCAYSMGFPSEAAASMAEAGVRPQDRADEKGASGSGSSPSDQPPASGNVTGNSNSTFISSGQVMNFKGDIIVVYVSQTSQEGPGSAEPESEPVGRPVQEETLAHRDSFAGTAPRFPDVCATGAGLQEQGAPRQKDGTSRPVQEQGGAQTSLHTQGSGQCAE

SEQ ID NO: 33 - protein, 501 aa, Homo sapiens
MTPGALLMLLGALGAPLAPGVRGSEAEGRLREKLFSGYDSSVRPAREVGDRVRVSVGLILAQLISLNEKDEEMSTKVYLDLEWTDYRLSWDPAEHDGIDSLRITAESVWLPDVVLLNNNDGNFDVALDISVVVSSDGSVRWQPPGIYRSSCSIQVTYFPFDWQNCTMVFSSYSYDSSEVSLQTGLGPDGQGHQEIHIHEGTFIENGQWEIIHKPSRLIQPPGDPRGGREGQRQEVIFYLIIRRKPLFYLVNVIAPCILITLLAIFVFYLPPDAGEKMGLSIFALLTLTVFLLLLADKVPETSLSVPIIIKYLMFTMVLVTFSVILSVVVLNLHHRSPHTHQMPLWVRQIFIHKLPLYLRLKRPKPERDLMPEPPHCSSPGSGWGRGTDEYFIRKPPSDFLFPKPNRFQPELSAPDLRRFIDGPNRAVALLPELREVVSSISYIARQLQEQEDHDALKEDWQFVAMVVDRLFLWTFIIFTSVGTLVIFLDATYHLPPPDPFP

SEQ ID NO: 34 - protein, 839 aa, Homo sapiens [sequence omitted]

SEQ ID NO: 35 - protein, 830 aa, Homo sapiens
MGLGLLLPLLLLWTRGTQGSELDPKGQHVCVASSPSAELQCCAGWRQKDQECTIPICEGPDACQKDEVCVKPGLCRCKPGFFGAHCSSRCPGQYWGPDCRESCPCHPHGQCEPATGACQCQADRWGARCEFPCACGPHGRCDPATGVCHCEPGWWSSTCRRPCQCNTAAARCEQATGACVCKPGWWGRRCSFRCNCHGSPCEQDSGRCACRPGWWGPECQQQCECVRGRCSAASGECTCPPGFRGARCELPCPAGSHGVQCAHSCGRCKHNEPCSPDTGSCESCEPGWNGTQCQQPCLPGTFGESCEQQCPHCRHGEACEPDTGHCQRCDPGWLGPRCEDPCPTGTFGEDCGSTCPTCVQGSCDTVTGDCVCSAGYWGPSCNASCPAGFHGNNCSVPCECPEGLCHPVSGSCQPGSGSRDTALIAGSLVPLLLLFLGLACCACCCWAPRSDLKDRPARDGATVSRMKLQVWGTLTSLGSTLPCRSLSSHKLPWVTVSHHDPEVPFNHSFIEPPSAGWATDDSFSSDPESGEADEVPAYCVPPQEGMVPVAQAGSSEASLAAGAFPPPEDASTPFAIPRTSSLARAKRPSVSFAEGTKFAPQSRRSSGELSSPLRKPKRLSRGAQSGPEGREAEESTGPEEAEAPESFPAAASPGDSATGHRRPPLGGRTVAEHVEAIEGSVQESSGPVTTIYMLAGKPRGSEGPVRSVFRHFGSFQKGQAEAKVKRAIPKPPRQALNRKKGSPGLASGSVGQSPNSAPKAGLPGATGPMAVRPEEAVRGLGAGTESSRRAQEPVSGCGSPEQDPQKQAEEERQEEPEYENVVPISRPPEP

SEQ ID NO: 36 - protein, 596 aa, Artificial Sequence
  CT 532: pLenti 1 CEA TCR TRAV8-1*01 TRBV26*01 with regular murine constant region
MHSLLGLLMVSLWLQLTRVNSQLAEENPWALSVHEGESVTVNCSYKTSITALQWYRQKSGEGPAQLILIRSNEREKRNGRLRATLDTSSQSSSLSITATRCEDTAVYFCATDLTSGGNYKFGKGTSLVVHPDIQNPEPAVYQLKDPRSQDSTLCLFTDFDSQINVPKTMESGTFITDKTVLDMKAMDSKSNGAIAWSNQTSFTCQDIFKETNATYPSSDVPCDATLTEKSFETDMNLNFQNLSVMGLRILLLKVAGFNLLMTLRLWSSGSGATNFSLLKQAGDVEENPGPMATRLLCYTVLCLLGARILNSKVIQTPRYLVKGQGQKAKMRCIPEKGHPVVFWYQQNKNNEFKFLINFQNQEVLQQIDMTEKRFSAECPSNSPCSLEIQSSEAGDSALYLCASSLGLGDYEQYFGPGTRLTVLEDLRNVTPPKVSLFEPSKAEIANKQKATLVCLARGFFPDHVELSWWVNGKEVHSGVSTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 37 - protein, 596 aa, Artificial Sequence
  CT 533: pLenti 1 CEA TCR TRAV8-1*01 TRBV26*01 L117T with regular murine constant region
MHSLLGLLMVSLWLQLTRVNSQLAEENPWALSVHEGESVTVNCSYKTSITALQWYRQKSGEGPAQLILIRSNEREKRNGRLRATLDTSSQSSSLSITATRCEDTAVYFCATDLTSGGNYKFGKGTSLVVHPDIQNPEPAVYQLKDPRSQDSTLCLFTDFDSQINVPKTMESGTFITDKTVLDMKAMDSKSNGAIAWSNQTSFTCQDIFKETNATYPSSDVPCDATLTEKSFETDMNLNFQNLSVMGLRILLLKVAGFNLLMTLRLWSSGSGATNFSLLKQAGDVEENPGPMATRLLCYTVLCLLGARILNSKVIQTPRYLVKGQGQKAKMRCIPEKGHPVVFWYQQNKNNEFKFLINFQNQEVLQQIDMTEKRFSAECPSNSPCSLEIQSSEAGDSALYLCASSLGTGDYEQYFGPGTRLTVLEDLRNVTPPKVSLFEPSKAEIANKQKATLVCLARGFFPDHVELSWWVNGKEVHSGVSTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 38 - protein, 596 aa, Artificial Sequence
  CT 534: pLenti 1 CEA TCR TRAV8-1*01 TRBV26*01 murine constant region (no PT)
MHSLLGLLMVSLWLQLTRVNSQLAEENPWALSVHEGESVTVNCSYKTSITALQWYRQKSGEGPAQLILIRSNEREKRNGRLRATLDTSSQSSSLSITATRCEDTAVYFCATDLTSGGNYKFGKGTSLVVHPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSGSGATNFSLLKQAGDVEENPGPMATRLLCYTVLCLLGARILNSKVIQTPRYLVKGQGQKAKMRCIPEKGHPVVFWYQQNKNNEFKFLINFQNQEVLQQIDMTEKRFSAECPSNSPCSLEIQSSEAGDSALYLCASSLGLGDYEQYFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 39 - protein, 596 aa, Artificial Sequence
  CT 535: pLenti 1 CEA TCR TRAV8-1*01 L110F TRBV26*01 with regular murine constant region
MHSLLGLLMVSLWLQLTRVNSQLAEENPWALSVHEGESVTVNCSYKTSITALQWYRQKSGEGPAQLILIRSNEREKRNGRLRATLDTSSQSSSLSITATRCEDTAVYFCATDFTSGGNYKFGKGTSLVVHPDIQNPEPAVYQLKDPRSQDSTLCLFTDFDSQINVPKTMESGTFITDKTVLDMKAMDSKSNGAIAWSNQTSFTCQDIFKETNATYPSSDVPCDATLTEKSFETDMNLNFQNLSVMGLRILLLKVAGFNLLMTLRLWSSGSGATNFSLLKQAGDVEENPGPMATRLLCYTVLCLLGARILNSKVIQTPRYLVKGQGQKAKMRCIPEKGHPVVFWYQQNKNNEFKFLINFQNQEVLQQIDMTEKRFSAECPSNSPCSLEIQSSEAGDSALYLCASSLGLGDYEQYFGPGTRLTVLEDLRNVTPPKVSLFEPSKAEIANKQKATLVCLARGFFPDHVELSWWVNGKEVHSGVSTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 40 - protein, 596 aa, Artificial Sequence
  CT 536: pLenti 1 CEA TCR TRAV8-1*01 S112T  TRBV26*01 with regular murine constant region
MHSLLGLLMVSLWLQLTRVNSQLAEENPWALSVHEGESVTVNCSYKTSITALQWYRQKSGEGPAQLILIRSNEREKRNGRLRATLDTSSQSSSLSITATRCEDTAVYFCATDLTTGGNYKFGKGTSLVVHPDIQNPEPAVYQLKDPRSQDSTLCLFTDFDSQINVPKTMESGTFITDKTVLDMKAMDSKSNGAIAWSNQTSFTCQDIFKETNATYPSSDVPCDATLTEKSFETDMNLNFQNLSVMGLRILLLKVAGFNLLMTLRLWSSGSGATNFSLLKQAGDVEENPGPMATRLLCYTVLCLLGARILNSKVIQTPRYLVKGQGQKAKMRCIPEKGHPVVFWYQQNKNNEFKFLINFQNQEVLQQIDMTEKRFSAECPSNSPCSLEIQSSEAGDSALYLCASSLGLGDYEQYFGPGTRLTVLEDLRNVTPPKVSLFEPSKAEIANKQKATLVCLARGFFPDHVELSWWVNGKEVHSGVSTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 41 - protein, 596 aa, Artificial Sequence
  CT 537: pLenti 1 CEA TCR TRAV8-1*01 L110F & S112T TRBV26*01 with regular murine constant region
MHSLLGLLMVSLWLQLTRVNSQLAEENPWALSVHEGESVTVNCSYKTSITALQWYRQKSGEGPAQLILIRSNEREKRNGRLRATLDTSSQSSSLSITATRCEDTAVYFCATDFTTGGNYKFGKGTSLVVHPDIQNPEPAVYQLKDPRSQDSTLCLFTDFDSQINVPKTMESGTFITDKTVLDMKAMDSKSNGAIAWSNQTSFTCQDIFKETNATYPSSDVPCDATLTEKSFETDMNLNFQNLSVMGLRILLLKVAGFNLLMTLRLWSSGSGATNFSLLKQAGDVEENPGPMATRLLCYTVLCLLGARILNSKVIQTPRYLVKGQGQKAKMRCIPEKGHPVVFWYQQNKNNEFKFLINFQNQEVLQQIDMTEKRFSAECPSNSPCSLEIQSSEAGDSALYLCASSLGLGDYEQYFGPGTRLTVLEDLRNVTPPKVSLFEPSKAEIANKQKATLVCLARGFFPDHVELSWWVNGKEVHSGVSTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 42 - protein, 596 aa, Artificial Sequence
  CT 538: pLenti 1 CEA TCR TRAV8-1*01 L110F TRBV26*01 L117T with regular murine constant region
MHSLLGLLMVSLWLQLTRVNSQLAEENPWALSVHEGESVTVNCSYKTSITALQWYRQKSGEGPAQLILIRSNEREKRNGRLRATLDTSSQSSSLSITATRCEDTAVYFCATDFTSGGNYKFGKGTSLVVHPDIQNPEPAVYQLKDPRSQDSTLCLFTDFDSQINVPKTMESGTFITDKTVLDMKAMDSKSNGAIAWSNQTSFTCQDIFKETNATYPSSDVPCDATLTEKSFETDMNLNFQNLSVMGLRILLLKVAGFNLLMTLRLWSSGSGATNFSLLKQAGDVEENPGPMATRLLCYTVLCLLGARILNSKVIQTPRYLVKGQGQKAKMRCIPEKGHPVVFWYQQNKNNEFKFLINFQNQEVLQQIDMTEKRFSAECPSNSPCSLEIQSSEAGDSALYLCASSLGTGDYEQYFGPGTRLTVLEDLRNVTPPKVSLFEPSKAEIANKQKATLVCLARGFFPDHVELSWWVNGKEVHSGVSTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 43 - protein, 596 aa, Artificial Sequence
  CT 539: pLenti 1 CEA TCR TRAV8-1*01 S112T TRBV26*01 L117T with regular murine constant region
MHSLLGLLMVSLWLQLTRVNSQLAEENPWALSVHEGESVTVNCSYKTSITALQWYRQKSGEGPAQLILIRSNEREKRNGRLRATLDTSSQSSSLSITATRCEDTAVYFCATDLTTGGNYKFGKGTSLVVHPDIQNPEPAVYQLKDPRSQDSTLCLFTDFDSQINVPKTMESGTFITDKTVLDMKAMDSKSNGAIAWSNQTSFTCQDIFKETNATYPSSDVPCDATLTEKSFETDMNLNFQNLSVMGLRILLLKVAGFNLLMTLRLWSSGSGATNFSLLKQAGDVEENPGPMATRLLCYTVLCLLGARILNSKVIQTPRYLVKGQGQKAKMRCIPEKGHPVVFWYQQNKNNEFKFLINFQNQEVLQQIDMTEKRFSAECPSNSPCSLEIQSSEAGDSALYLCASSLGTGDYEQYFGPGTRLTVLEDLRNVTPPKVSLFEPSKAEIANKQKATLVCLARGFFPDHVELSWWVNGKEVHSGVSTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 44 - protein, 596 aa, Artificial Sequence
  CT 540: pLenti 1 CEA TCR TRAV8-1*01 L110F & S112T TRBV26*01 L117T with regular murine constant region
MHSLLGLLMVSLWLQLTRVNSQLAEENPWALSVHEGESVTVNCSYKTSITALQWYRQKSGEGPAQLILIRSNEREKRNGRLRATLDTSSQSSSLSITATRCEDTAVYFCATDFTTGGNYKFGKGTSLVVHPDIQNPEPAVYQLKDPRSQDSTLCLFTDFDSQINVPKTMESGTFITDKTVLDMKAMDSKSNGAIAWSNQTSFTCQDIFKETNATYPSSDVPCDATLTEKSFETDMNLNFQNLSVMGLRILLLKVAGFNLLMTLRLWSSGSGATNFSLLKQAGDVEENPGPMATRLLCYTVLCLLGARILNSKVIQTPRYLVKGQGQKAKMRCIPEKGHPVVFWYQQNKNNEFKFLINFQNQEVLQQIDMTEKRFSAECPSNSPCSLEIQSSEAGDSALYLCASSLGTGDYEQYFGPGTRLTVLEDLRNVTPPKVSLFEPSKAEIANKQKATLVCLARGFFPDHVELSWWVNGKEVHSGVSTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 45 - protein, 596 aa, Artificial Sequence
  CT 541: pLenti 1 CEA TCR TRAV8-1*01 L110F TRBV26*01 with murine constant region
MHSLLGLLMVSLWLQLTRVNSQLAEENPWALSVHEGESVTVNCSYKTSITALQWYRQKSGEGPAQLILIRSNEREKRNGRLRATLDTSSQSSSLSITATRCEDTAVYFCATDFTSGGNYKFGKGTSLVVHPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSGSGATNFSLLKQAGDVEENPGPMATRLLCYTVLCLLGARILNSKVIQTPRYLVKGQGQKAKMRCIPEKGHPVVFWYQQNKNNEFKFLINFQNQEVLQQIDMTEKRFSAECPSNSPCSLEIQSSEAGDSALYLCASSLGLGDYEQYFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 46 - protein, 596 aa, Artificial Sequence
  CT 542:  pLenti 1 CEA TCR TRAV8-1*01 S112T TRBV26*01 with murine constant region
MHSLLGLLMVSLWLQLTRVNSQLAEENPWALSVHEGESVTVNCSYKTSITALQWYRQKSGEGPAQLILIRSNEREKRNGRLRATLDTSSQSSSLSITATRCEDTAVYFCATDLTTGGNYKFGKGTSLVVHPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSGSGATNFSLLKQAGDVEENPGPMATRLLCYTVLCLLGARILNSKVIQTPRYLVKGQGQKAKMRCIPEKGHPVVFWYQQNKNNEFKFLINFQNQEVLQQIDMTEKRFSAECPSNSPCSLEIQSSEAGDSALYLCASSLGLGDYEQYFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 47 - protein, 596 aa, Artificial Sequence
  CT 543: pLenti 1 CEA TCR TRAV8-1*01 L110F & S112T TRBV26*01 with murine constant region
MHSLLGLLMVSLWLQLTRVNSQLAEENPWALSVHEGESVTVNCSYKTSITALQWYRQKSGEGPAQLILIRSNEREKRNGRLRATLDTSSQSSSLSITATRCEDTAVYFCATDFTTGGNYKFGKGTSLVVHPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSGSGATNFSLLKQAGDVEENPGPMATRLLCYTVLCLLGARILNSKVIQTPRYLVKGQGQKAKMRCIPEKGHPVVFWYQQNKNNEFKFLINFQNQEVLQQIDMTEKRFSAECPSNSPCSLEIQSSEAGDSALYLCASSLGLGDYEQYFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 48 - protein, 596 aa, Artificial Sequence
  CT 544: pLenti 1 CEA TCR  TRAV8-1*01 TRBV26*01 L117T with murine constant region
MHSLLGLLMVSLWLQLTRVNSQLAEENPWALSVHEGESVTVNCSYKTSITALQWYRQKSGEGPAQLILIRSNEREKRNGRLRATLDTSSQSSSLSITATRCEDTAVYFCATDLTSGGNYKFGKGTSLVVHPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSGSGATNFSLLKQAGDVEENPGPMATRLLCYTVLCLLGARILNSKVIQTPRYLVKGQGQKAKMRCIPEKGHPVVFWYQQNKNNEFKFLINFQNQEVLQQIDMTEKRFSAECPSNSPCSLEIQSSEAGDSALYLCASSLGTGDYEQYFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 49 - protein, 596 aa, Artificial Sequence
  CT 545: pLenti 1 CEA TCR TRAV8-1*01 L110F TRBV26*01 L117T with murine constant region
MHSLLGLLMVSLWLQLTRVNSQLAEENPWALSVHEGESVTVNCSYKTSITALQWYRQKSGEGPAQLILIRSNEREKRNGRLRATLDTSSQSSSLSITATRCEDTAVYFCATDFTSGGNYKFGKGTSLVVHPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSGSGATNFSLLKQAGDVEENPGPMATRLLCYTVLCLLGARILNSKVIQTPRYLVKGQGQKAKMRCIPEKGHPVVFWYQQNKNNEFKFLINFQNQEVLQQIDMTEKRFSAECPSNSPCSLEIQSSEAGDSALYLCASSLGTGDYEQYFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 50 - protein, 596 aa, Artificial Sequence
  CT 546: pLenti 1 CEA TCR TRAV8-1*01 S112T TRBV26*01 L117T with murine constant region
MHSLLGLLMVSLWLQLTRVNSQLAEENPWALSVHEGESVTVNCSYKTSITALQWYRQKSGEGPAQLILIRSNEREKRNGRLRATLDTSSQSSSLSITATRCEDTAVYFCATDLTTGGNYKFGKGTSLVVHPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSGSGATNFSLLKQAGDVEENPGPMATRLLCYTVLCLLGARILNSKVIQTPRYLVKGQGQKAKMRCIPEKGHPVVFWYQQNKNNEFKFLINFQNQEVLQQIDMTEKRFSAECPSNSPCSLEIQSSEAGDSALYLCASSLGTGDYEQYFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 51 - protein, 596 aa, Artificial Sequence
  CT 547: pLenti 1 CEA TCR TRAV8-1*01 L110F & S112T TRBV26*01 L117T with murine constant region
MHSLLGLLMVSLWLQLTRVNSQLAEENPWALSVHEGESVTVNCSYKTSITALQWYRQKSGEGPAQLILIRSNEREKRNGRLRATLDTSSQSSSLSITATRCEDTAVYFCATDFTTGGNYKFGKGTSLVVHPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSGSGATNFSLLKQAGDVEENPGPMATRLLCYTVLCLLGARILNSKVIQTPRYLVKGQGQKAKMRCIPEKGHPVVFWYQQNKNNEFKFLINFQNQEVLQQIDMTEKRFSAECPSNSPCSLEIQSSEAGDSALYLCASSLGTGDYEQYFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 52 - protein, 535 aa, Artificial Sequence
  CT618: CAR with scFv that target  CEA
MDMRVPAQLLGLLLLWLRGARCQVQLVQSGSELKKPGASVKVSCKASGYTFTEFGMNWVRQAPGQGLEWMGWINTKTGEATYVEEFKGRFVFSLDTSVSTAYLQISSLKAEDTAVYYCARWDFAYYVEAMDYWGQGTTVTVSSGGGGSGGGGSGGGGSGGDIQMTQSPSSLSASVGDRVTITCKASQNVGTNVAWYQQKPGKAPKLLIYSASYRYSGVPSRFSGSGSGTDFTLTISSLQPEDFATYYCHQYYTYPLFTFGQGTKLEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 53 - protein, 537 aa, Artificial Sequence
  CT619: CAR with scFv that target  CEA
MDMRVPAQLLGLLLLWLRGARCQVQLVQSGAEVKKPGASVKVSCKASGYTFTEFGMNWVRQAPGQGLEWMGWINTKTGEATYVEEFKGRVTFTTDTSTSTAYMELRSLRSDDTAVYYCARWDFAYYVEAMDYWGQGTTVTVSSGGGGSGGGGSGGGGSGGDIQMTQSPSSLSASVGDRVTITCKASAAVGTYVAWYQQKPGKAPKLLIYSASYRKRGVPSRFSGSGSGTDFTLTISSLQPEDFATYYCHQYYTYPLFTFGQGTKLEIKRTTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 54 - protein, 536 aa, Artificial Sequence
  CT620: CAR with scFv that target  CEA
MDMRVPAQLLGLLLLWLRGARCQVQLVQSGSELKKPGASVKVSCKASGYTFTEFGMNWVRQAPGQGLEWMGWINTKTGEATYVEEFKGRFVFSLDTSVSTAYLQISSLKAEDTAVYYCARWDFAHYFQTMDYWGQGTTVTVSSGGGGSGGGGSGGGGSGGDIQMTQSPSSLSASVGDRVTITCKASAAVGTYVAWYQQKPGKAPKLLIYSASYRKRGVPSRFSGSGSGTDFTLTISSLQPEDFATYYCHQYYTYPLFTFGQGTKLEIKRTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 55 - protein, 5 aa, Artificial Sequence
  CEA scFv CDR-H1
EFGMN

SEQ ID NO: 56 - protein, 17 aa, Artificial Sequence
  CEA scFv CDR-H2
WINTKTGEATYVEEFKG

SEQ ID NO: 57 - protein, 12 aa, Artificial Sequence
  CEA scFv CDR-H3
WDFAYYVEAMDY

SEQ ID NO: 58 - protein, 12 aa, Artificial Sequence
  CEA scFv CDR-H3
WDFAHYFQTMDY

SEQ ID NO: 59 - protein, 11 aa, Artificial Sequence
  CEA scFv CDR-L1
KASQNVGTNVA

SEQ ID NO: 60 - protein, 11 aa, Artificial Sequence
  CEA scFv CDR-L1
KASAAVGTYVA

SEQ ID NO: 61 - protein, 7 aa, Artificial Sequence
  CEA scFv CDR-L2
SASYRYS

SEQ ID NO: 62 - protein, 7 aa, Artificial Sequence
  CEA scFv CDR-L2
SASYRYS

SEQ ID NO: 63 - protein, 10 aa, Artificial Sequence
  CEA scFv CDR-L3
HQYYTYPLFT

SEQ ID NO: 64 - protein, 243 aa, Artificial Sequence
  scFv that targets CEA
QVQLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSGGENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELK

SEQ ID NO: 65 - protein, 243 aa, Artificial Sequence
  scFv that targets CEA
QVQLVQSGAEVKKPGASVKVSCKASGFNIKDSYMHWVRQAPGQGLEWMGWIDPENGDTEYAPKFQGRVTMTTDTSTSTAYMELRSLRSDDTAVYYCNEGTPTGPYYFDYWGQGTTVTVSSGGGGSGGGGSGGGGSGGEIVLTQSPATLSLSPGERATLSCSASSSVSYMHWYQQKPGLAPRLLIYSTSNLASGIPDRFSGSGSGTDFTLTISRLEPEDFAVYYCQQRSSYPLTFGQGTKLEIK

SEQ ID NO: 66 - protein, 243 aa, Artificial Sequence
  scFv that targets CEA
EVQLAESGGGLVQPGGSLRLSCAASGFTFSSDAMSWVRQAPGKGLEWVSAISGSGGSTYYADSVKGRFTISRDNSKNTLYLQMNSLRAEDTAVYYCAKSNEFLFDYWGQGTLVTVSSGGGGSGGGGSGGGGSGGSSELTQDPAVSVALGQTVRITCQGDSLRSSYASWYRQRPGQAPVLVIYGKNNRPSGIPDRFSGSSSGNTASLTITGAQAEDEADYYWNSSYAWLPYVVFGGGTKLTVLG

SEQ ID NO: 67 - protein, 243 aa, Artificial Sequence
  scFv that targets CEA
QVQLEQSGAGVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSSGGGGSGGGGSGGGGSGGENVLTQSPSSMSVSVGDRVNIACSASSSVPYMHWLQQKPGKSPKLLIYLTSNLASGVPSRFSGSGSGTDYSLTISSVQPEDAATYYCQQRSSYPLTFGGGTKLEIK

SEQ ID NO: 68 - protein, 246 aa, Artificial Sequence
  scFv that targets CEA
QVQLVQSGSELKKPGASVKVSCKASGYTFTEFGMNWVRQAPGQGLEWMGWINTKTGEATYVEEFKGRFVFSLDTSVSTAYLQISSLKAEDTAVYYCARWDFAYYVEAMDYWGQGTTVTVSSGGGGSGGGGSGGGGSGGDIQMTQSPSSLSASVGDRVTITCKASQNVGTNVAWYQQKPGKAPKLLIYSASYRYSGVPSRFSGSGSGTDFTLTISSLQPEDFATYYCHQYYTYPLFTFGQGTKLEIK

SEQ ID NO: 69 - protein, 246 aa, Artificial Sequence
  scFv that targets CEA
QVQLVQSGAEVKKPGASVKVSCKASGYTFTEFGMNWVRQAPGQGLEWMGWINTKTGEATYVEEFKGRVTFTTDTSTSTAYMELRSLRSDDTAVYYCARWDFAYYVEAMDYWGQGTTVTVSSGGGGSGGGGSGGGGSGGDIQMTQSPSSLSASVGDRVTITCKASAAVGTYVAWYQQKPGKAPKLLIYSASYRKRGVPSRFSGSGSGTDFTLTISSLQPEDFATYYCHQYYTYPLFTFGQGTKLEIK

SEQ ID NO: 70 - protein, 246 aa, Artificial Sequence
  scFv that targets CEA
QVQLVQSGSELKKPGASVKVSCKASGYTFTEFGMNWVRQAPGQGLEWMGWINTKTGEATYVEEFKGRFVFSLDTSVSTAYLQISSLKAEDTAVYYCARWDFAHYFQTMDYWGQGTTVTVSSGGGGSGGGGSGGGGSGGDIQMTQSPSSLSASVGDRVTITCKASAAVGTYVAWYQQKPGKAPKLLIYSASYRKRGVPSRFSGSGSGTDFTLTISSLQPEDFATYYCHQYYTYPLFTFGQGTKLEIK

SEQ ID NO: 71 - protein, 45 aa, Unknown
  CD8alpha hinge
TTTPAPRPPTPAPTIASQPLSLRPEACRPAAGGAVHTRGLDFACD

SEQ ID NO: 72 - DNA, 135 bp, Unknown
  CD8alpha hinge
accacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgat

SEQ ID NO: 73 - protein, 41 aa, Unknown
  CD28 hinge
CTIEVMYPPPYLDNEKSNGTIIHVKGKHLCPSPLFPGPSKP

SEQ ID NO: 74 - DNA, 123 bp, Unknown
  CD28 hinge
tgtaccattgaagttatgtatcctcctccttacctagacaatgagaagagcaatggaaccattatccatgtgaaagggaaacacctttgtccaagtcccctatttcccggaccttctaagccc

SEQ ID NO: 75 - protein, 27 aa, Unknown
  CD28 transmembrane domain
FWVLVVVGGVLACYSLLVTVAFIIFWV

SEQ ID NO: 76 - DNA, 81 bp, Unknown
  CD28 transmembrane domain
ttctgggtgctggtcgttgtgggcggcgtgctggcctgctacagcctgctggtgacagtggccttcatcatcttttgggtg

SEQ ID NO: 77 - protein, 25 aa, Unknown
  IL-2Rbeta transmembrane domain
IPWLGHLLVGLSGAFGFIILVYLLI

SEQ ID NO: 78 - DNA, 75 bp, Unknown
  IL-2Rbeta transmembrane domain
attccgtggctcggccacctcctcgtgggcctcagcggggcttttggcttcatcatcttagtgtacttgctgatc

SEQ ID NO: 79 - protein, 112 aa, Unknown
  CD3zeta activation domain
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 80 - DNA, 336 bp, Unknown
  CD3zeta activation domain
agagtgaagttcagcaggagcgcagacgcccccgcgtacaagcagggccagaaccagctctataacgagctcaatctaggacgaagagaggagtacgatgttttggacaagcgtagaggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggactcagtacagccaccaaggacacctacgacgcccttcacatgcaggccctgccccctcgc

SEQ ID NO: 81 - protein, 43 aa, Unknown
  CD3zeta activation domain
RVKFSRSADAPAYQQGQNQLYNELNLGRREEYDVLHMQALPPR

SEQ ID NO: 82 - DNA, 129 bp, Unknown
  CD3zeta activation domain
agagtgaagttcagcaggagcgcagacgcccccgcgtaccagcagggccagaaccagctctataacgagctcaatctaggacgaagagaggagtacgatgttttgcacatgcaggccctgccccctcgc

SEQ ID NO: 83 - protein, 41 aa, Unknown
  CD28 co-stimulatory domain
RSKRSRLLHSDYMNMTPRRPGPTRKHYQPYAPPRDFAAYRS

SEQ ID NO: 84 - DNA, 123 bp, Unknown
  CD28 co-stimulatory domain
aggagcaagcggagcagactgctgcacagcgactacatgaacatgaccccccggaggcctggccccacccggaagcactaccagccctacgcccctcccagggatttcgccgcctaccggagc

SEQ ID NO: 85 - protein, 23 aa, Unknown
  TCR alpha transmembrane domain
VIGFRILLLKVAGFNLLMTLRLW

SEQ ID NO: 86 - DNA, 69 bp, Unknown
  TCR alpha transmembrane domain
gtgattgggttccgaatcctcctcctgaaagtggccgggtttaatctgctcatgacgctgcggctgtgg

SEQ ID NO: 87 - protein, 23 aa, Unknown
  TCR beta transmembrane domain
TILYEILLGKATLYAVLVSALVL

SEQ ID NO: 88 - DNA, 69 bp, Unknown
  TCR beta transmembrane domain
accatcctctatgagatcttgctagggaaggccaccttgtatgccgtgctggtcagtgccctcgtgctg

SEQ ID NO: 89 - protein, 10 aa, Unknown
  TCR beta intracellular domain
MAMVKRKDSR

SEQ ID NO: 90 - DNA, 30 bp, Unknown
  TCR beta intracellular domain
atggccatggtcaagagaaaggattccaga

SEQ ID NO: 91 - protein, 247 aa, Mus musculus
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPRTSGGGTKLEIKGGGGSGGGGSGGGGSGGQVQLQQSGPELVKPGASVRISCKASGYTFTSYHIHWVKQRPGQGLEWIGWIYPGNVNTEYNEKFKGKATLTADKSSSTAYMHLSSLTSEDSAVYFCAREEITYAMDYWGQGTSVTVSS

SEQ ID NO: 92 - protein, 247 aa, Artificial Sequence
  humanized HLA-A*02 antigen binding domain
QVQLVQSGAEVKKPGSSVKVSCKASGYTFTSYHIHWVRQAPGQGLEWMGWIYPGNVNTEYNEKFKGKATITADKSTSTAYMELSSLRSEDTAVYYCAREEITYAMDYWGQGTTVTVSSGGGGSGGGGSGGGGSGGEIVLTQSPGTLSLSPGERATLSCRSSQSIVHSNGNTYLEWYQQKPGQAPRLLIYKVSNRFSGIPDRFSGSGSGTDFTLTISRLEPEDFAVYYCFQGSHVPRTFGGGTKVEIK

SEQ ID NO: 93 - protein, 247 aa, Artificial Sequence
  humanized HLA-A*02 antigen binding domain
QVQLVQSGAEVKKPGSSVKVSCKASGYTFTSYHIHWVRQAPGQGLEWMGWIYPGNVNTEYNEKFKGKATITADKSTSTAYMELSSLRSEDTAVYYCAREEITYAMDYWGQGTTVTVSSGGGGSGGGGSGGGGSGGDIVMTQTPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPRTFGGGTKVEIK

SEQ ID NO: 94 - protein, 247 aa, Artificial Sequence
  humanized HLA-A*02 antigen binding domain
EVQLVESGGGLVKPGGSLRLSCAASGYTFTSYHIHWVRQAPGKGLEWVGWIYPGNVNTEYNEKFKGRFTISRDDSKNTLYLQMNSLKTEDTAVYYCAREEITYAMDYWGQGTTVTVSSGGGGSGGGGSGGGGSGGDIQMTQSPSSLSASVGDRVTITCRSSQSIVHSNGNTYLEWYQQKPGKAPKLLIYKVSNRFSGVPSRFSGSGSGTDFTLTISSLQPEDFATYYCFQGSHVPRTFGGGTKVEIK

SEQ ID NO: 95 - protein, 247 aa, Artificial Sequence
  humanized HLA-A*02 antigen binding domain
QVQLVQSGAEVKKPGSSVKVSCKASGYTFTSYHIHWVRQAPGQGLEWIGWIYPGNVNTEYNEKFKGKATITADESTNTAYMELSSLRSEDTAVYYCAREEITYAMDYWGQGTLVTVSSGGGGSGGGGSGGGGSGGDIQMTQSPSTLSASVGDRVTITCRSSQSIVHSNGNTYLEWYQQKPGKAPKLLIYKVSNRFSGVPARFSGSGSGTEFTLTISSLQPDDFATYYCFQGSHVPRTFGQGTKVEVK

SEQ ID NO: 96 - protein, 247 aa, Artificial Sequence
  humanized HLA-A*02 antigen binding domain
QVQLVQSGAEVKKPGSSVKVSCKASGYTFTSYHMHWVRQAPGQGLEWIGYIYPGNVNTEYNEKFKGKATLTADKSTNTAYMELSSLRSEDTAVYFCAREEITYAMDYWGQGTLVTVSSGGGGSGGGGSGGGGSGGDVQMTQSPSTLSASVGDRVTITCSSSQSIVHSNGNTYMEWYQQKPGKAPKLLIYKVSNRFSGVPDRFSGSGSGTEFTLTISSLQPDDFATYYCHQGSHVPRTFGQGTKVEVK

SEQ ID NO: 97 - protein, 247 aa, Mus musculus
QVQLQQSGPELVKPGASVKMSCKASGYTFTSYHIQWVKQRPGQGLEWIGWIYPGDGSTQYNEKFKGKTTLTADKSSSTAYMLLSSLTSEDSAIYFCAREGTYYAMDYWGQGTSVTVSSGGGGSGGGGSGGGGSGGDVLMTQTPLSLPVSLGDQVSISCRSSQSIVHSNGNTYLEWYLQKPGQSPKLLIYKVSNRFSGVPDRFSGSGSGTDFTLKISRVEAEDLGVYYCFQGSHVPRTFGGGTKLEIK

SEQ ID NO: 98 - protein, 247 aa, Artificial Sequence
  humanized HLA-A*02 antigen binding domain
QLQLQESGPGLVKPSETLSLTCTVSGYTFTSYHIQWIRQPPGKGLEWIGWIYPGDGSTQYNEKFKGRATISVDTSKNQFSLNLDSVSAADTAIYYCAREGTYYAMDYWGKGSTVTVSSGGGGSGGGGSGGGGSGGDIQMTQSPSSLSASVGDRVTITCRSSQSIVHSNGNTYLEWYQQKPGKAPKLLIYKVSNRFSGVPSRFSGSGSGTDFTFTISSLQPEDIATYYCFQGSHVPRTFGPGTKVDIK

SEQ ID NO: 99 - protein, 247 aa, Artificial Sequence
  humanized HLA-A*02 antigen binding domain
EVQLVQSGAELKKPGSSVKVSCKASGYTFTSYHIQWVKQAPGQGLEWIGWIYPGDGSTQYNEKFKGKATLTVDKSTNTAYMELSSLRSEDTAVYYCAREGTYYAMDYWGQGTLVTVSSGGGGSGGGGSGGGGSGGDIQMTQSPSTLSASVGDRVTITCRSSQSIVHSNGNTYLEWYQQKPGKAPKLLIYKVSNRFSGVPSRFSGSGSGTDFTLTISSLQPDDFATYYCFQGSHVPRTFGQGTKVEVK

SEQ ID NO: 100 - protein, 247 aa, Artificial Sequence
  humanized HLA-A*02 antigen binding domain
QVQLVQSGAEVKKPGSSVKVSCKASGYTFTSYHIQWVRQAPGQGLEWMGWIYPGDGSTQYNEKFKGRVTITADKSTSTAYMELSSLRSEDTAVYYCAREGTYYAMDYWGQGTTVTVSSGGGGSGGGGSGGGGSGGEIVLTQSPGTLSLSPGERATLSCRSSQSIVHSNGNTYLEWYQQKPGQAPRLLIYKVSNRFSGIPDRFSGSGSGTDFTLTISRLEPEDFAVYYCFQGSHVPRTFGGGTKVEIK

SEQ ID NO: 101 - protein, 247 aa, Artificial Sequence
  humanized HLA-A*02 antigen binding domain
QVTLKQSGAEVKKPGSSVKVSCTASGYTFTSYHVSWVRQAPGQGLEWLGRIYPGDGSTQYNEKFKGKVTITADKSMDTSFMELTSLTSEDTAVYYCAREGTYYAMDLWGQGTLVTVSSGGGGSGGGGSGGGGSGGEIVLTQSPGTLSLSPGERATLSCRSSQSIVHSNGNTYLAWYQQKPGQAPRLLISKVSNRFSGVPDRFSGSGSGTDFTLTISRLEPEDFAVYYCQQGSHVPRTFGGGTKVEIK

SEQ ID NO: 102 - protein, 247 aa, Artificial Sequence
  humanized HLA-A*02 antigen binding domain
QVQLVQSGAEVKKPGASVKVSCKASGYTFTSYHMHWVRQAPGQRLEWMGWIYPGDGSTQYNEKFKGKVTITRDTSASTAYMELSSLRSEDTAVYYCAREGTYYAMDYWGQGTLVTVSSGGGGSGGGGSGGGGSGGDIVMTQTPLSLPVTPGEPASISCRSSQSIVHSNGNTYLDWYLQKPGQSPQLLIYKVSNRFSGVPDRFSGSGSGTDFTLKISRVEAEDVGVYYCMQGSHVPRTFGGGTKVEIK

SEQ ID NO: 103 - protein, 16 aa, Artificial Sequence
  HLA antigen binding domain CDR-L1
RSSQSIVHSNGNTYLE

SEQ ID NO: 104 - protein, 12 aa, Artificial Sequence
  HLA antigen binding domain CDR-L2
KVSNRFSGVPDR

SEQ ID NO: 105 - protein, 9 aa, Artificial Sequence
  HLA antigen binding domain CDR-L3
FQGSHVPRT

SEQ ID NO: 106 - protein, 12 aa, Artificial Sequence
  HLA antigen binding domain CDR-H1
ASGYTFTSYHIH

SEQ ID NO: 107 - protein, 18 aa, Artificial Sequence
  HLA antigen binding domain CDR-H2
WIYPGNVNTEYNEKFKGK

SEQ ID NO: 108 - protein, 9 aa, Artificial Sequence
  HLA antigen binding domain CDR-H3
EEITYAMDY

SEQ ID NO: 109 - protein, 16 aa, Artificial Sequence
  HLA antigen binding domain CDR-L1
RSSQSIVHSNGNTYLD

SEQ ID NO: 110 - protein, 12 aa, Artificial Sequence
  HLA antigen binding domain CDR-L2
KVSNRFSGVPDR

SEQ ID NO: 111 - protein, 9 aa, Artificial Sequence
  HLA antigen binding domain CDR-L3
MQGSHVPRT

SEQ ID NO: 112 - protein, 11 aa, Artificial Sequence
  HLA antigen binding domain CDR-H1
SGYTFTSYHMH

SEQ ID NO: 113 - protein, 17 aa, Artificial Sequence
  HLA antigen binding domain CDR-H2
WIYPGDGSTQYNEKFKG

SEQ ID NO: 114 - protein, 9 aa, Artificial Sequence
  HLA antigen binding domain CDR-H3
EGTYYAMDY

SEQ ID NO: 115 - protein, 670 aa, Unknown
  LILRB1
MTPILTVLICLGLSLGPRTHVQAGHLPKPTLWAEPGSVITQGSPVTLRCQGGQETQEYRLYREKKTALWITRIPQELVKKGQFPIPSITWEHAGRYRCYYGSDTAGRSESSDPLELVVTGAYIKPTLSAQPSPVVNSGGNVILQCDSQVAFDGFSLCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIHPSQEGPSPAVPSIYATLAIH

SEQ ID NO: 116 - DNA, 3229 bp, Unknown
  LILRB1
aaatgagttttaaaaaggcttgtccaggaagcacatatgggagctggtcactctgcattttgggccctcctggaggtgtttagaccttccgagagagaaactgagacacatgagagggaagaaatgactcagtggtgagaccctgtggagtcccacccacaaccagcacactgtgacccactgcacaaacctctagcccacagctcacttcctcctttaagaagagaagagaaaagaggagaggagaggaggaacagaaaagaaaagaaaagaaaaagtgggaaacaaataatctaagaatgaggagaaagcaagaagagtgacccccttgtgggcactccattggttttatggcgcctctactttctggagtttgtgtaaaacaaaaatattatggtctttgtgcacatttacatcaagctcagcctgggcggcacagccagatgcgagatgcgtctctgctgatctgagtctgcctgcagcatggacctgggtcttccctgaagcatctccagggctggagggacgactgccatgcaccgagggctcatccatccacagagcagggcagtgggaggagacgccatgacccccatcctcacggtcctgatctgtctcgggctgagtctgggcccccggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcaccctggattacacggatcccacaggagcttgtgaagaagggccagttccccatcccatccatcacctgggaacacacagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaaccctccagtgtgactcacaggtggcatttgatggcttcattctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccacgaatgaatgaattaggaaagaaaaaaagtaggaaatgaatgatcttggctttcctataagaaatttagggcagggcacggtggctcacgcctgtaattccagcactttgggaggccgaggcgggcagatcacgagttcaggagatcgagaccatcttggccaacatggtgaaaccctgtctctcctaaaaatacaaaaattagctggatgtggtggcagtgcctgtaatcccagctatttgggaggctgaggcaggagaatcgcttgaaccagggagtcagaggtttcagtgagccaagatcgcaccactgctctccagcctggcgacagagggagactccatctcaaattaaaaaaaaaaaaaaaaaagaaagaaaaaaaaaaaaaaaaaa

SEQ ID NO: 117 - protein, 6 aa, Unknown
  immunoreceptor tyrosine-based inhibitory motif
NLYAAV

SEQ ID NO: 118 - protein, 6 aa, Unknown
  immunoreceptor tyrosine-based inhibitory motif
VTYAEV

SEQ ID NO: 119 - protein, 6 aa, Unknown
  immunoreceptor tyrosine-based inhibitory motif
VTYAQL

SEQ ID NO: 120 - protein, 6 aa, Unknown
  immunoreceptor tyrosine-based inhibitory motif
SIYATL

SEQ ID NO: 121 - protein, 35 aa, Unknown
  ITIM1-2
NLYAAVKHTQPEDGVEMDTRSPHDEDPQAVTYAEV

SEQ ID NO: 122 - protein, 58 aa, Unknown
  ITIM2-3
VTYAEVKHSRPRREMASPPSPLSGEFLDTKDRQAEEDRQMDTEAAASEAPQDVTYAQL

SEQ ID NO: 123 - protein, 36 aa, Unknown
  ITIM3-4
VTYAQLHSLTLRREATEPPPSQEGPSPAVPSIYATL

SEQ ID NO: 124 - protein, 87 aa, Unknown
  ITIM1-3
NLYAAVKHTQPEDGVEMDTRSPHDEDPQAVTYAEVKHSRPRREMASPPSPLSGEFLDTKDRQAEEDRQMDTEAAASEAPQDVTYAQL

SEQ ID NO: 125 - protein, 88 aa, Unknown
  ITIM2-4
VTYAEVKHSRPRREMASPPSPLSGEFLDTKDRQAEEDRQMDTEAAASEAPQDVTYAQLHSLTLRREATEPPPSQEGPSPAVPSIYATL

SEQ ID NO: 126 - protein, 117 aa, Unknown
  ITIM1-4
NLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATL

SEQ ID NO: 127 - protein, 20 aa, Unknown
  D3D4 domain
YGSQSSKPYLLTHPSDPLEL

SEQ ID NO: 128 - protein, 43 aa, Unknown
  Short hinge
VVSGPSGGPSSPTTGPTSTSGPEDQPLTPTGSDPQSGLGRHLG

SEQ ID NO: 129 - protein, 86 aa, Unknown
  Hinge-transmembrane
YGSQSSKPYLLTHPSDPLELVVSGPSGGPSSPTTGPTSTSGPEDQPLTPTGSDPQSGLGRHLGVVIGILVAVILLLLLLLLLFLIL

SEQ ID NO: 130 - protein, 190 aa, Unknown
  Transmembrane-intracellular domain
VVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 131 - protein, 167 aa, Unknown
  LILRB1 intracellular domain
RHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 132 - protein, 253 aa, Unknown
  LILRB1 hinge-transmembrane-intracellular domain
YGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 133 - protein, 233 aa, Unknown
  LILRB1 hinge-transmembrane-intracellular domain
VVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 134 - protein, 63 aa, Unknown
  LILRB1 hinge domain
YGSQSSKPYLLTHPSDPLELVVSGPSGGPSSPTTGPTSTSGPEDQPLTPTGSDPQSGLGRHLG

SEQ ID NO: 135 - protein, 23 aa, Unknown
  LILRB1 transmembrane domain
VVIGILVAVILLLLLLLLLFLIL

SEQ ID NO: 136 - protein, 273 aa, Homo sapiens
MSGSQSEVAPSPQSPRSPEMGRDLRPGSRVLLLLLLLLLVYLTQPGNGNEGSVTGSCYCGKRISSDSPPSVQFMNRLRKHLRAYHRCLYYTRFQLLSWSVCGGNKDPWVQELMSCLDLKECGHAYSGIVAHQKHLLPTSPPISQASEGASSDIHTPAQMLLSTLQSTQRPTLPVGSLSSDKELTRPNETTIHTAGHSLAAGPEAGENQKQPEKNAGPTARTSATVPVLCLLAIIFILTAALSYVLCKRRRGQSPQSSPDLPVHYIPVAPDSNT

SEQ ID NO: 137 - protein, 742 aa, Homo sapiens
MKDDFAEEEEVQSFGYKRFGIQEGTQCTKCKNNWALKFSIILLYILCALLTITVAILGYKVVEKMDNVTGGMETSRQTYDDKLTAVESDLKKLGDQTGKKAISTNSELSTFRSDILDLRQQLREITEKTSKNKDTLEKLQASGDALVDRQSQLKETLENNSFLITTVNKTLQAYNGYVTNLQQDTSVLQGNLQNQMYSHNVVIMNLNNLNLTQVQQRNLITNLQRSVDDTSQAIQRIKNDFQNLQQVFLQAKKDTDWLKEKVQSLQTLAANNSALAKANNDTLEDMNSQLNSFTGQMENITTISQANEQNLKDLQDLHKDAENRTAIKFNQLEERFQLFETDIVNIISNISYTAHHLRTLTSNLNEVRTTCTDTLTKHTDDLTSLNNTLANIRLDSVSLRMQQDLMRSRLDTEVANLSVIMEEMKLVDSKHGQLIKNFTILQGPPGPRGPRGDRGSQGPPGPTGNKGQKGEKGEPGPPGPAGERGPIGPAGPPGERGGKGSKGSQGPKGSRGSPGKPGPQGSSGDPGPPGPPGKEGLPGPQGPPGFQGLQGTVGEPGVPGPRGLPGLPGVPGMPGPKGPPGPPGPSGAVVPLALQNEPTPAPEDNGCPPHWKNFTDKCYYFSVEKEIFEDAKLFCEDKSSHLVFINTREEQQWIKKQMVGRESHWIGLTDSERENEWKWLDGTSPDYKNWKAGQPDNWGHGHGPGEDCAGLIYAGQWNDFQCEDVNNFICEKDRETVLSSAL

SEQ ID NO: 138 - protein, 514 aa, Homo sapiens
MSWPRRLLLRYLFPALLLHGLGEGSALLHPDSRSHPRSLEKSAWRAFKESQCHHMLKHLHNGARITVQMPPTIEGHWVSTGCEVRSGPEFITRSYRFYHNNTFKAYQFYYGSNRCTNPTYTLIIRGKIRLRQASWIIRGGTEADYQLHNVQVICHTEAVAEKLGQQVNRTCPGFLADGGPWVQDVAYDLWREENGCECTKAVNFAMHELQLIRVEKQYLHHNLDHLVEELFLGDIHTDATQRMFYRPSSYQPPLQNAKNHDHACIACRIIYRSDEHHPPILPPKADLTIGLHGEWVSQRCEVRPEVLFLTRHFIFHDNNNTWEGHYYHYSDPVCKHPTFSIYARGRYSRGVLSSRVMGGTEFVFKVNHMKVTPMDAATASLLNVFNGNECGAEGSWQVGIQQDVTHTNGCVALGIKLPHTEYEIFKMEQDARGRYLLFNGQRPSDGSSPDRPEKRATSYQMPLVQCASSSPRAEDLAEDSGSSLYGRAPGRHTWSLLLAALACLVPLLHWNIRR

SEQ ID NO: 139 - protein, 227 aa, Homo sapiens
  SITE (1)..(1): Xaa is any amino acid
XDVAYDLWREENGCECTKAVNFAMHELQLIRVEKQYLHHNLDHLVEELFLGDIHTDATQRMFYRPSSYQPPLQNAKCAAESSGSFQILPQDSSEKEQNGLSHWCLSRPGHQKDWALCAHAGPATAGCPSCLWPPAETGRKAGRTSSKTVHACPGEAGTSSFELFYFPNCWSIETKLKISLNAKLSFKPRASAPLETGHRVKIETLSQLVFLSFIQLCCEVQSPLANK

SEQ ID NO: 140 - protein, 93 aa, Homo sapiens
EDVLPALQLPAPSAECQVEMGFHHVGQDGLQLPTSSDPPALASQSAGITGVSHRPPGRHLSNDLRTTTMPASPVGSSIGQTSTTLPSCPQRQT

SEQ ID NO: 141 - protein, 1078 aa, Artificial Sequence
  CEA CAR-T2A-HLA-A*02 inhibitory Receptor
MDMRVPAQLLGLLLLWLRGARCDVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPRTSGGGTKLEIKGGGGSGGGGSGGGGSGGQVQLQQSGPELVKPGASVRISCKASGYTFTSYHIHWVKQRPGQGLEWIGWIYPGNVNTEYNEKFKGKATLTADKSSSTAYMHLSSLTSEDSAVYFCAREEITYAMDYWGQGTSVTVSSYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIHGSGEGRGSLLTCGDVEENPGPMDMRVPAQLLGLLLLWLRGARCQVQLVQSGSELKKPGASVKVSCKASGYTFTEFGMNWVRQAPGQGLEWMGWINTKTGEATYVEEFKGRFVFSLDTSVSTAYLQISSLKAEDTAVYYCARWDFAYYVEAMDYWGQGTTVTVSSGGGGSGGGGSGGGGSGGDIQMTQSPSSLSASVGDRVTITCKASQNVGTNVAWYQQKPGKAPKLLIYSASYRYSGVPSRFSGSGSGTDFTLTISSLQPEDFATYYCHQYYTYPLFTFGQGTKLEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 142 - DNA, 3237 bp, Artificial Sequence
  CEA CAR-T2A-HLA-A*02 inhibitory Receptor
atggatatgagagtgcctgcccagctgctcggactgctccttctgtggttgagaggagctcggtgcgatgttctgatgacccaaactccactctccctgcctgtcagtcttggagatcaagcctccatctcttgcagatctagtcagagcattgtacatagtaatggaaacacctatttagaatggtacctgcagaagccaggccagtctccaaagctgctcatctacaaagtttccaaccgattttctggggtcccagacagatttagcggatctggctctgggaccgatttcacactcaagatcagtagagtggaggctgaggatctgggagtttattactgctttcaaggttcacatgttcctcggacgtccggtggaggcacaaagctggaaatcaagggaggtggcggctctggaggcggaggtagcggaggtggaggctctggtggccaggtccagctgcagcagtctggacctgagctggtgaagccaggggcttcagtgaggatatcctgtaaggcctctggctacacctttacaagttaccatatacattgggtgaagcagaggcctggacagggactcgaatggattggatggatttatcctggaaatgttaatactgagtacaatgagaagttcaagggcaaggccacactgactgcagacaaatcgtccagcacagcctacatgcacctcagcagcctgacctctgaggactctgcggtctatttctgtgccagagaggagattacctatgctatggattattggggtcaaggaacctcagtcaccgtgtcctcatacggctcacagagctccaaaccctacctgctgactcaccctagtgatcctctggagctcgtggtctcaggaccgtctggaggcccaagctctccgacaacaggccccacctccacatctggccctgaggaccagcccctcacacccaccgggtcggatcctcagagtggtctgggaagacacctgggagttgtgatcggcatcttggtggccgtcatcctactgctcctcctcctgctcctgctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggatactcggagcccacacgatgaagatccacaggcagtgacgtatgccgaggtgaaacactccagacctagaagggaaatggcctctcctccttccccactgtctggagagttcctggacacaaaggacagacaggcggaagaggacaggcagatggacactgaggctgctgcatctgaagctcctcaggatgtgacctacgcccagctgcacagcttgaccctcagacgggaggcaactgagcctcctccatcccaggaagggccctctccagctgtgcccagcatctacgccactctggccatccacggatccggagagggcagaggcagcctgctgacatgtggcgacgtggaagagaaccctggccccatggacatgagggtccccgctcagctcctggggctcctgctactctggctccgaggtgccagatgtcaggtgcagctggtgcaatctgggtctgagttgaagaagcctggggcctcagtgaaggtttcctgcaaggcttctggatacaccttcactgagtttggaatgaactgggtgcgacaggcccctggacaagggcttgagtggatgggatggataaacaccaaaactggagaggcaacatatgttgaagagtttaagggacggtttgtcttctccttggacacctctgtcagcacggcatatctgcagatcagcagcctaaaggctgaagacactgccgtgtattactgtgcgagatgggacttcgcttattacgtggaggctatggactactggggccaagggaccacggtgaccgtgtcatccggcggaggtggaagcggagggggaggatctggcggcggaggaagcggaggcgatatccagatgacccagtctccatcctccctgtctgcatctgtgggagacagagtcaccatcacttgcaaggccagtcagaatgtgggtactaatgttgcctggtatcagcagaaaccagggaaagcacctaagctcctgatctattcggcatcctaccgctacagtggagtcccatcaaggttcagtggcagtggatctgggacagatttcactctcaccatcagcagtctgcaacctgaagatttcgcaacttactactgtcaccaatattacacctatcctctattcacgtttggccagggcaccaagctcgagatcaagacaacgacgccagctccccgcccgccaacccctgcacctacgattgcatcacaaccgctgtccctgcggcctgaagcttgtcgcccagccgcaggtggcgccgtacatacacgggggctggattttgcctgtgatttctgggtgctggtcgttgtgggcggcgtgctggcctgctacagcctgctggtgacagtggccttcatcatcttttgggtgaggagcaagcggagtcgactgctgcacagcgactacatgaacatgaccccccggaggcctggccccacccggaagcactaccagccctacgcccctcccagggatttcgccgcctaccggagcaaacggggcagaaagaaactcctgtatatattcaaacaaccatttatgaggccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagcgtagaggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggactcagtacagccaccaaggacacctacgacgcccttcacatgcaggccctgccccctcgctaa

SEQ ID NO: 143 - DNA, 1605 bp, Artificial Sequence
  CEA CAR
atggacatgagggtccccgctcagctcctggggctcctgctactctggctccgaggtgccagatgtcaggtgcagctggtgcaatctgggtctgagttgaagaagcctggggcctcagtgaaggtttcctgcaaggcttctggatacaccttcactgagtttggaatgaactgggtgcgacaggcccctggacaagggcttgagtggatgggatggataaacaccaaaactggagaggcaacatatgttgaagagtttaagggacggtttgtcttctccttggacacctctgtcagcacggcatatctgcagatcagcagcctaaaggctgaagacactgccgtgtattactgtgcgagatgggacttcgcttattacgtggaggctatggactactggggccaagggaccacggtgaccgtgtcatccggcggaggtggaagcggagggggaggatctggcggcggaggaagcggaggcgatatccagatgacccagtctccatcctccctgtctgcatctgtgggagacagagtcaccatcacttgcaaggccagtcagaatgtgggtactaatgttgcctggtatcagcagaaaccagggaaagcacctaagctcctgatctattcggcatcctaccgctacagtggagtcccatcaaggttcagtggcagtggatctgggacagatttcactctcaccatcagcagtctgcaacctgaagatttcgcaacttactactgtcaccaatattacacctatcctctattcacgtttggccagggcaccaagctcgagatcaagacaacgacgccagctccccgcccgccaacccctgcacctacgattgcatcacaaccgctgtccctgcggcctgaagcttgtcgcccagccgcaggtggcgccgtacatacacgggggctggattttgcctgtgatttctgggtgctggtcgttgtgggcggcgtgctggcctgctacagcctgctggtgacagtggccttcatcatcttttgggtgaggagcaagcggagtcgactgctgcacagcgactacatgaacatgaccccccggaggcctggccccacccggaagcactaccagccctacgcccctcccagggatttcgccgcctaccggagcaaacggggcagaaagaaactcctgtatatattcaaacaaccatttatgaggccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagcgtagaggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggactcagtacagccaccaaggacacctacgacgcccttcacatgcaggccctgccccctcgc

SEQ ID NO: 144 - protein, 121 aa, Artificial Sequence
  CEA VH region
QVQLVQSGSELKKPGASVKVSCKASGYTFTEFGMNWVRQAPGQGLEWMGWINTKTGEATYVEEFKGRFVFSLDTSVSTAYLQISSLKAEDTAVYYCARWDFAYYVEAMDYWGQGTTVTVSS

SEQ ID NO: 145 - DNA, 363 bp, Artificial Sequence
  CEA VH region
caggtgcagctggtgcaatctgggtctgagttgaagaagcctggggcctcagtgaaggtttcctgcaaggcttctggatacaccttcactgagtttggaatgaactgggtgcgacaggcccctggacaagggcttgagtggatgggatggataaacaccaaaactggagaggcaacatatgttgaagagtttaagggacggtttgtcttctccttggacacctctgtcagcacggcatatctgcagatcagcagcctaaaggctgaagacactgccgtgtattactgtgcgagatgggacttcgcttattacgtggaggctatggactactggggccaagggaccacggtgaccgtgtcatcc

SEQ ID NO: 146 - protein, 17 aa, Artificial Sequence
  Linker
GGGGSGGGGSGGGGSGG

SEQ ID NO: 147 - DNA, 51 bp, Artificial Sequence
  Linker
ggcggaggtggaagcggagggggaggatctggcggcggaggaagcggaggc

SEQ ID NO: 148 - protein, 108 aa, Artificial Sequence
  CEA VL region
DIQMTQSPSSLSASVGDRVTITCKASQNVGTNVAWYQQKPGKAPKLLIYSASYRYSGVPSRFSGSGSGTDFTLTISSLQPEDFATYYCHQYYTYPLFTFGQGTKLEIK

SEQ ID NO: 149 - DNA, 324 bp, Artificial Sequence
  CEA VL region
gatatccagatgacccagtctccatcctccctgtctgcatctgtgggagacagagtcaccatcacttgcaaggccagtcagaatgtgggtactaatgttgcctggtatcagcagaaaccagggaaagcacctaagctcctgatctattcggcatcctaccgctacagtggagtcccatcaaggttcagtggcagtggatctgggacagatttcactctcaccatcagcagtctgcaacctgaagatttcgcaacttactactgtcaccaatattacacctatcctctattcacgtttggccagggcaccaagctcgagatcaag

SEQ ID NO: 150 - DNA, 15 bp, Artificial Sequence
  CDR-H1
gagtttggaatgaac

SEQ ID NO: 151 - DNA, 51 bp, Artificial Sequence
  CDR-H2
tggataaacaccaaaactggagaggcaacatatgttgaagagtttaaggga

SEQ ID NO: 152 - DNA, 36 bp, Artificial Sequence
  CDR-H3
tgggacttcgcttattacgtggaggctatggactac

SEQ ID NO: 153 - DNA, 33 bp, Artificial Sequence
  CDR-L1
aaggccagtcagaatgtgggtactaatgttgcc

SEQ ID NO: 154 - DNA, 21 bp, Artificial Sequence
  CDR-L2
tcggcatcctaccgctacagt

SEQ ID NO: 155 - DNA, 30 bp, Artificial Sequence
  CDR-L3
caccaatattacacctatcctctattcacg

SEQ ID NO: 156 - DNA, 135 bp, Artificial Sequence
  CD8alpha hinge
acaacgacgccagctccccgcccgccaacccctgcacctacgattgcatcacaaccgctgtccctgcggcctgaagcttgtcgcccagccgcaggtggcgccgtacatacacgggggctggattttgcctgtgat

SEQ ID NO: 157 - DNA, 81 bp, Artificial Sequence; identical to SEQ ID NO: 76
  CD28 transmembrane domain

SEQ ID NO: 158 - protein, 195 aa, Artificial Sequence
  CD28-41BB-CD3zeta intracellular domain
RSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 159 - DNA, 585 bp, Artificial Sequence
  CD28-41BB-CD3zeta intracellular domain
aggagcaagcggagtcgactgctgcacagcgactacatgaacatgaccccccggaggcctggccccacccggaagcactaccagccctacgcccctcccagggatttcgccgcctaccggagcaaacggggcagaaagaaactcctgtatatattcaaacaaccatttatgaggccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagcgtagaggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggactcagtacagccaccaaggacacctacgacgcccttcacatgcaggccctgccccctcgc

SEQ ID NO: 160 - DNA, 123 bp, Unknown
  CD28 co-stimulatory domain
aggagcaagcggagtcgactgctgcacagcgactacatgaacatgaccccccggaggcctggccccacccggaagcactaccagccctacgcccctcccagggatttcgccgcctaccggagc

SEQ ID NO: 161 - protein, 42 aa, Unknown
  4-1BB
KRGRKKLLYIFKQPFMRPVQTTQEEDGCSCRFPEEEEGGCEL

SEQ ID NO: 162 - DNA, 126 bp, Unknown
  4-1BB
aaacggggcagaaagaaactcctgtatatattcaaacaaccatttatgaggccagtacaaactactcaagaggaagatggctgtagctgccgatttccagaagaagaagaaggaggatgtgaactg

SEQ ID NO: 163 - DNA, 336 bp, Unknown; identical to SEQ ID NO: 80
  CD3zeta

SEQ ID NO: 164 - protein, 522 aa, Artificial Sequence
  Inhibitory Receptor anti-HLA-A*02 scFv - LILRB1 hinge, TM and ICD
MDMRVPAQLLGLLLLWLRGARCDVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPRTSGGGTKLEIKGGGGSGGGGSGGGGSGGQVQLQQSGPELVKPGASVRISCKASGYTFTSYHIHWVKQRPGQGLEWIGWIYPGNVNTEYNEKFKGKATLTADKSSSTAYMHLSSLTSEDSAVYFCAREEITYAMDYWGQGTSVTVSSYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 165 - DNA, 1566 bp, Artificial Sequence
  Inhibitory Receptor anti-HLA-A*02 scFv - LILRB1 hinge, TM and ICD
atggatatgagagtgcctgcccagctgctcggactgctccttctgtggttgagaggagctcggtgcgatgttctgatgacccaaactccactctccctgcctgtcagtcttggagatcaagcctccatctcttgcagatctagtcagagcattgtacatagtaatggaaacacctatttagaatggtacctgcagaagccaggccagtctccaaagctgctcatctacaaagtttccaaccgattttctggggtcccagacagatttagcggatctggctctgggaccgatttcacactcaagatcagtagagtggaggctgaggatctgggagtttattactgctttcaaggttcacatgttcctcggacgtccggtggaggcacaaagctggaaatcaagggaggtggcggctctggaggcggaggtagcggaggtggaggctctggtggccaggtccagctgcagcagtctggacctgagctggtgaagccaggggcttcagtgaggatatcctgtaaggcctctggctacacctttacaagttaccatatacattgggtgaagcagaggcctggacagggactcgaatggattggatggatttatcctggaaatgttaatactgagtacaatgagaagttcaagggcaaggccacactgactgcagacaaatcgtccagcacagcctacatgcacctcagcagcctgacctctgaggactctgcggtctatttctgtgccagagaggagattacctatgctatggattattggggtcaaggaacctcagtcaccgtgtcctcatacggctcacagagctccaaaccctacctgctgactcaccctagtgatcctctggagctcgtggtctcaggaccgtctggaggcccaagctctccgacaacaggccccacctccacatctggccctgaggaccagcccctcacacccaccgggtcggatcctcagagtggtctgggaagacacctgggagttgtgatcggcatcttggtggccgtcatcctactgctcctcctcctgctcctgctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggatactcggagcccacacgatgaagatccacaggcagtgacgtatgccgaggtgaaacactccagacctagaagggaaatggcctctcctccttccccactgtctggagagttcctggacacaaaggacagacaggcggaagaggacaggcagatggacactgaggctgctgcatctgaagctcctcaggatgtgacctacgcccagctgcacagcttgaccctcagacgggaggcaactgagcctcctccatcccaggaagggccctctccagctgtgcccagcatctacgccactctggccatccac

SEQ ID NO: 166 - protein, 112 aa, Artificial Sequence
  Inhibitory Receptor VL
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPRTSGGGTKLEIK

SEQ ID NO: 167 - DNA, 336 bp, Artificial Sequence
  Inhibitory Receptor VL
gatgttctgatgacccaaactccactctccctgcctgtcagtcttggagatcaagcctccatctcttgcagatctagtcagagcattgtacatagtaatggaaacacctatttagaatggtacctgcagaagccaggccagtctccaaagctgctcatctacaaagtttccaaccgattttctggggtcccagacagatttagcggatctggctctgggaccgatttcacactcaagatcagtagagtggaggctgaggatctgggagtttattactgctttcaaggttcacatgttcctcggacgtccggtggaggcacaaagctggaaatcaag

SEQ ID NO: 168 - DNA, 51 bp, Artificial Sequence
  linker
ggaggtggcggctctggaggcggaggtagcggaggtggaggctctggtggc

SEQ ID NO: 169 - DNA, 48 bp, Artificial Sequence
  Inhibitory Receptor CDR-L1
agatctagtcagagcattgtacatagtaatggaaacacctatttagaa

SEQ ID NO: 170 - DNA, 36 bp, Artificial Sequence
  Inhibitory Receptor CDR-L2
aaagtttccaaccgattttctggggtcccagacaga

SEQ ID NO: 171 - DNA, 27 bp, Artificial Sequence
  Inhibitory Receptor CDR-L3
tttcaaggttcacatgttcctcggacg

SEQ ID NO: 172 - DNA, 36 bp, Artificial Sequence
  Inhibitory Receptor CDR-H1
gcctctggctacacctttacaagttaccatatacat

SEQ ID NO: 173 - DNA, 54 bp, Artificial Sequence
  Inhibitory Receptor CDR-H2
tggatttatcctggaaatgttaatactgagtacaatgagaagttcaagggcaag

SEQ ID NO: 174 - DNA, 27 bp, Artificial Sequence
  Inhibitory Receptor CDR-H3
gaggagattacctatgctatggattat

SEQ ID NO: 175 - DNA, 759 bp, Artificial Sequence
  LILR1B hinge, TM and ICD
tacggctcacagagctccaaaccctacctgctgactcaccctagtgatcctctggagctcgtggtctcaggaccgtctggaggcccaagctctccgacaacaggccccacctccacatctggccctgaggaccagcccctcacacccaccgggtcggatcctcagagtggtctgggaagacacctgggagttgtgatcggcatcttggtggccgtcatcctactgctcctcctcctgctcctgctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggatactcggagcccacacgatgaagatccacaggcagtgacgtatgccgaggtgaaacactccagacctagaagggaaatggcctctcctccttccccactgtctggagagttcctggacacaaaggacagacaggcggaagaggacaggcagatggacactgaggctgctgcatctgaagctcctcaggatgtgacctacgcccagctgcacagcttgaccctcagacgggaggcaactgagcctcctccatcccaggaagggccctctccagctgtgcccagcatctacgccactctggccatccac

SEQ ID NO: 176 - DNA, 189 bp, Artificial Sequence
  LILRB1 hinge
tacggctcacagagctccaaaccctacctgctgactcaccctagtgatcctctggagctcgtggtctcaggaccgtctggaggcccaagctctccgacaacaggccccacctccacatctggccctgaggaccagcccctcacacccaccgggtcggatcctcagagtggtctgggaagacacctggga

SEQ ID NO: 177 - DNA, 69 bp, Artificial Sequence
  LILRB1 TM
gttgtgatcggcatcttggtggccgtcatcctactgctcctcctcctgctcctgctcttcctcatcctc

SEQ ID NO: 178 - DNA, 501 bp, Artificial Sequence
  LILRB1 ICD
cgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggatactcggagcccacacgatgaagatccacaggcagtgacgtatgccgaggtgaaacactccagacctagaagggaaatggcctctcctccttccccactgtctggagagttcctggacacaaaggacagacaggcggaagaggacaggcagatggacactgaggctgctgcatctgaagctcctcaggatgtgacctacgcccagctgcacagcttgaccctcagacgggaggcaactgagcctcctccatcccaggaagggccctctccagctgtgcccagcatctacgccactctggccatccac

SEQ ID NO: 179 - DNA, 46 bp, Unknown
  B2M shRNA
gcactcaaagcttgttaagatcgaaatcttaacaagctttgagtgc

SEQ ID NO: 180 - DNA, 46 bp, Unknown
  B2M shRNA
gttaacttccaatttacataccgaagtatgtaaattggaagttaac

SEQ ID NO: 181 - protein, 21 aa, Unknown
  T2A self-cleaving polypeptide
GSGEGRGSLLTCGDVEENPGP

SEQ ID NO: 182 - protein, 1179 aa, Homo sapiens; identical to SEQ ID NO: 14

SEQ ID NO: 183 - protein, 1163 aa, Homo sapiens
MTRTRAALLLFTALATSLGFNLDTEELTAFRVDSAGFGDSVVQYANSWVVVGAPQKITAANQTGGLYQCGYSTGACEPIGLQVPPEAVNMSLGLSLASTTSPSQLLACGPTVHHECGRNMYLTGLCFLLGPTQLTQRLPVSRQECPRQEQDIVFLIDGSGSISSRNFATMMNFVRAVISQFQRPSTQFSLMQFSNKFQTHFTFEEFRRSSNPLSLLASVHQLQGFTYTATAIQNVVHRLFHASYGARRDAAKILIVITDGKKEGDSLDYKDVIPMADAAGIIRYAIGVGLAFQNRNSWKELNDIASKPSQEHIFKVEDFDALKDIQNQLKEKIFAIEGTETTSSSSFELEMAQEGFSAVFTPDGPVLGAVGSFTWSGGAFLYPPNMSPTFINMSQENVDMRDSYLGYSTELALWKGVQSLVLGAPRYQHTGKAVIFTQVSRQWRMKAEVTGTQIGSYFGASLCSVDVDSDGSTDLVLIGAPHYYEQTRGGQVSVCPLPRGWRRWWCDAVLYGEQGHPWGRFGAALTVLGDVNGDKLTDVVIGAPGEEENRGAVYLFHGVLGPSISPSHSQRIAGSQLSSRLQYFGQALSGGQDLTQDGLVDLAVGARGQVLLLRTRPVLWVGVSMQFIPAEIPRSAFECREQVVSEQTLVQSNICLYIDKRSKNLLGSRDLQSSVTLDLALDPGRLSPRATFQETKNRSLSRVRVLGLKAHCENFNLLLPSCVEDSVTPITLRLNFTLVGKPLLAFRNLRPMLAADAQRYFTASLPFEKNCGADHICQDNLGISFSFPGLKSLLVGSNLELNAEVMVWNDGEDSYGTTITFSHPAGLSYRYVAEGQKQGQLRSLHLTCDSAPVGSQGTWSTSCRINHLIFRGGAQITFLATFDVSPKAVLGDRLLLTANVSSENNTPRTSKTTFQLELPVKYAVYTVVSSHEQFTKYLNFSESEEKESHVAMHRYQVNNLGQRDLPVSINFWVPVELNQEAVWMDVEVSHPQNPSLRCSSEKIAPPASDFLAHIQKNPVLDCSIAGCLRFRCDVPSFSVQEELDFTLKGNLSFGWVRQILQKKVSVVSVAEITFDTSVYSQLPGQEAFMRAQTTTVLEKYKVHNPTPLIVGSSIGGLLLLALITAVLYKVGFFKRQYKEMMEEANGQIAPENGTQTPSPPSEK

SEQ ID NO: 184 - protein, 22 aa, Unknown
  signal sequence
MDMRVPAQLLGLLLLWLRGARC

SEQ ID NO: 185 - DNA, 66 bp, Unknown
  signal sequence
atggacatgagggtccccgctcagctcctggggctcctgctactctggctccgaggtgccagatgt

SEQ ID NO: 186 - protein, 19 aa, Unknown
  P2A self-cleaving peptide
ATNFSLLKQAGDVEENPGP

SEQ ID NO: 187 - DNA, 1800 bp, Artificial Sequence
  CT 548: pLenti 1 CEA TCR TRAV8-1*01 118P & 119T with murine constant region
atgcacagcctcctggggttgttgatggtgtcactgtggctgcaactgacaagggtgaatagtcaactagcagaagagaatccgtgggccctgagcgtccacgagggtgaaagtgtcacggtgaattgtagttacaagacatccataactgccctacagtggtacagacagaagtcaggcgaaggccctgcccagctaatcttaatacgttcaaatgagagagagaagcgcaatggaagactcagagccacccttgacacctccagccagagcagctccttgtccatcactgctactcggtgtgaagacaccgctgtgtacttctgtgctactgatctaacctcaggaggaaactacaaacctacgtttgggaaagggaccagcctcgtggttcatccagacattcagaaccccgaaccagccgtatatcagttgaaggacccaagatctcaggatagtacactctgtttgtttacggactttgactcacaaatcaacgtcccgaagactatggaaagtggtacgttcatcacagataagacggttctggacatgaaggctatggactcaaagagcaacggggcaattgcttggtccaaccagacaagctttacctgtcaggacatttttaaggagactaatgctacttatccctccagcgacgttccgtgtgatgcgactcttaccgagaagtcttttgagaccgatatgaatctcaacttccagaatctgtcagtgatgggtctgcggatcctgcttctgaaggttgcaggattcaatcttcttatgactctccggctctggtcttcaggttctggcgcgacgaattttagtttgcttaagcaagccggagatgtggaggaaaatcctggaccgatggctacaaggctcctctgttacacagtactttgtctcctgggtgcaagaattttgaactcaaaagtcattcagactccaagatatctggtgaaagggcaaggacaaaaagcaaagatgaggtgtatccctgaaaagggacatccagttgtattctggtatcaacaaaataagaacaatgagtttaaatttttgattaactttcagaatcaagaagttcttcagcaaatagacatgactgaaaaacgattctctgctgagtgtccttcaaactcaccttgcagcctagaaattcagtcctctgaggcaggagactcagcactgtacctctgtgccagcagtctgggactgggggactatgaacagtacttcggtcccggcaccaggctcacggttttagaggatctccggaacgtcaccccaccaaaggtcagtttgtttgagccatcaaaggcggagatcgccaacaaacagaaagctacgctcgtgtgtttggctcggggcttcttcccagaccacgtagaactttcctggtgggtcaatggaaaggaggttcattccggagtgtccactgatccccaagcgtacaaggaatccaactatagctactgtctctcatctcggctccgggtgagtgcgacattctggcataatcctcggaaccactttcgatgccaagtgcagtttcatgggttgagcgaggaagacaagtggcccgagggcagtcctaaaccagtcactcaaaacataagcgccgaggcatggggtagagccgattgtgggattactagcgcttcataccaacaaggggtattgagcgctacaattctttacgaaattctcctcggcaaggcgacgctctacgccgtactggtgtctactctcgtggttatggcaatggtgaaacggaaaaacagctaatag

SEQ ID NO: 188 - DNA, 1800 bp, Artificial Sequence
  CT 549: pLenti 1 CEA TCR TRAV8-1*01 118P & 119T TRBV26*01 L117T with murine constant region
atgcacagcctcctggggttgttgatggtgtcactgtggctgcaactgacaagggtgaatagtcaactagcagaagagaatccgtgggccctgagcgtccacgagggtgaaagtgtcacggtgaattgtagttacaagacatccataactgccctacagtggtacagacagaagtcaggcgaaggccctgcccagctaatcttaatacgttcaaatgagagagagaagcgcaatggaagactcagagccacccttgacacctccagccagagcagctccttgtccatcactgctactcggtgtgaagacaccgctgtgtacttctgtgctactgatctaacctcaggaggaaactacaaacctacgtttgggaaagggaccagcctcgtggttcatccagacattcagaaccccgaaccagccgtatatcagttgaaggacccaagatctcaggatagtacactctgtttgtttacggactttgactcacaaatcaacgtcccgaagactatggaaagtggtacgttcatcacagataagacggttctggacatgaaggctatggactcaaagagcaacggggcaattgcttggtccaaccagacaagctttacctgtcaggacatttttaaggagactaatgctacttatccctccagcgacgttccgtgtgatgcgactcttaccgagaagtcttttgagaccgatatgaatctcaacttccagaatctgtcagtgatgggtctgcggatcctgcttctgaaggttgcaggattcaatcttcttatgactctccggctctggtcttcaggttctggcgcgacgaattttagtttgcttaagcaagccggagatgtggaggaaaatcctggaccgatggctacaaggctcctctgttacacagtactttgtctcctgggtgcaagaattttgaactcaaaagtcattcagactccaagatatctggtgaaagggcaaggacaaaaagcaaagatgaggtgtatccctgaaaagggacatccagttgtattctggtatcaacaaaataagaacaatgagtttaaatttttgattaactttcagaatcaagaagttcttcagcaaatagacatgactgaaaaacgattctctgctgagtgtccttcaaactcaccttgcagcctagaaattcagtcctctgaggcaggagactcagcactgtacctctgtgccagcagtctggggacaggggactatgaacagtacttcggtcccggcaccaggctcacggttttagaggatctccggaacgtcaccccaccaaaggtcagtttgtttgagccatcaaaggcggagatcgccaacaaacagaaagctacgctcgtgtgtttggctcggggcttcttcccagaccacgtagaactttcctggtgggtcaatggaaaggaggttcattccggagtgtccactgatccccaagcgtacaaggaatccaactatagctactgtctctcatctcggctccgggtgagtgcgacattctggcataatcctcggaaccactttcgatgccaagtgcagtttcatgggttgagcgaggaagacaagtggcccgagggcagtcctaaaccagtcactcaaaacataagcgccgaggcatggggtagagccgattgtgggattactagcgcttcataccaacaaggggtattgagcgctacaattctttacgaaattctcctcggcaaggcgacgctctacgccgtactggtgtctactctcgtggttatggcaatggtgaaacggaaaaacagctaatag

SEQ ID NO: 189 - DNA, 1800 bp, Artificial Sequence
  CT 550: pLenti 1 CEA TCR TRAV8-1*01 118P & 119T with murine constant region
atgcacagcctcctggggttgttgatggtgtcactgtggctgcaactgacaagggtgaatagtcaactagcagaagagaatccgtgggccctgagcgtccacgagggtgaaagtgtcacggtgaattgtagttacaagacatccataactgccctacagtggtacagacagaagtcaggcgaaggccctgcccagctaatcttaatacgttcaaatgagagagagaagcgcaatggaagactcagagccacccttgacacctccagccagagcagctccttgtccatcactgctactcggtgtgaagacaccgctgtgtacttctgtgctactgatctaacctcaggaggaaactacaaacctacgtttgggaaagggaccagcctcgtggttcatccaaatattcagaaccccgaaccagccgtatatcagttgaaggacccaagatctcaggatagtacactctgtttgtttacggactttgactcacaaatcaacgtcccgaagactatggaaagtggtacgttcatcacagataagtgcgttctggacatgaaggctatggactcaaagagcaacggggcaattgcttggtccaaccagacaagctttacctgtcaggacatttttaaggagactaatgctacttatccctccagcgacgttccgtgtgatgcgactcttaccgagaagtcttttgagaccgatatgaatctcaacttccagaatctgctggtgatcgttctgcggatcctgcttctgaaggttgcaggattcaatcttcttatgactctccggctctggtcttcaggttctggcgcgacgaattttagtttgcttaagcaagccggagatgtggaggaaaatcctggaccgatggctacaaggctcctctgttacacagtactttgtctcctgggtgcaagaattttgaactcaaaagtcattcagactccaagatatctggtgaaagggcaaggacaaaaagcaaagatgaggtgtatccctgaaaagggacatccagttgtattctggtatcaacaaaataagaacaatgagtttaaatttttgattaactttcagaatcaagaagttcttcagcaaatagacatgactgaaaaacgattctctgctgagtgtccttcaaactcaccttgcagcctagaaattcagtcctctgaggcaggagactcagcactgtacctctgtgccagcagtctgggactgggggactatgaacagtacttcggtcccggcaccaggctcacggttttagaggacctgcgcaacgtcaccccaccaaaggtcagtttgtttgagccatcaaaggcggagatcgccaacaaacagaaagctacgctcgtgtgtttggctcggggcttcttcccagaccacgtagaactttcctggtgggtcaatggaaaggaggttcattccggagtgtgcactgatccccaagcgtacaaggaatccaactatagctactgtctctcatctcggctccgggtgagtgcgacattctggcataatcctcggaaccactttcgatgccaagtgcagtttcatgggttgagcgaggaagacaagtggcccgagggcagtcctaaaccagtcactcaaaacataagcgccgaggcatggggtagagccgattgtgggattactagcgcttcataccaacaaggggtattgagcgctacaattctttacgaaattctcctcggcaaggcgacgctctacgccgtactggtgtctactctcgtggttatggcaatggtgaaacggaaaaacagctaatag

SEQ ID NO: 190 - DNA, 1800 bp, Artificial Sequence
  CT 551: pLenti 1 CEA TCR TRAV8-1*01 L110F 118P & 119T with murine constant region
atgcacagcctcctggggttgttgatggtgtcactgtggctgcaactgacaagggtgaatagtcaactagcagaagagaatccgtgggccctgagcgtccacgagggtgaaagtgtcacggtgaattgtagttacaagacatccataactgccctacagtggtacagacagaagtcaggcgaaggccctgcccagctaatcttaatacgttcaaatgagagagagaagcgcaatggaagactcagagccacccttgacacctccagccagagcagctccttgtccatcactgctactcggtgtgaagacaccgctgtgtacttctgtgctactgatttcacctcaggaggaaactacaaacctacgtttgggaaagggaccagcctcgtggttcatccagacattcagaaccccgaaccagccgtatatcagttgaaggacccaagatctcaggatagtacactctgtttgtttacggactttgactcacaaatcaacgtcccgaagactatggaaagtggtacgttcatcacagataagacggttctggacatgaaggctatggactcaaagagcaacggggcaattgcttggtccaaccagacaagctttacctgtcaggacatttttaaggagactaatgctacttatccctccagcgacgttccgtgtgatgcgactcttaccgagaagtcttttgagaccgatatgaatctcaacttccagaatctgtcagtgatgggtctgcggatcctgcttctgaaggttgcaggattcaatcttcttatgactctccggctctggtcttcaggttctggcgcgacgaattttagtttgcttaagcaagccggagatgtggaggaaaatcctggaccgatggctacaaggctcctctgttacacagtactttgtctcctgggtgcaagaattttgaactcaaaagtcattcagactccaagatatctggtgaaagggcaaggacaaaaagcaaagatgaggtgtatccctgaaaagggacatccagttgtattctggtatcaacaaaataagaacaatgagtttaaatttttgattaactttcagaatcaagaagttcttcagcaaatagacatgactgaaaaacgattctctgctgagtgtccttcaaactcaccttgcagcctagaaattcagtcctctgaggcaggagactcagcactgtacctctgtgccagcagtctgggactgggggactatgaacagtacttcggtcccggcaccaggctcacggttttagaggatctccggaacgtcaccccaccaaaggtcagtttgtttgagccatcaaaggcggagatcgccaacaaacagaaagctacgctcgtgtgtttggctcggggcttcttcccagaccacgtagaactttcctggtgggtcaatggaaaggaggttcattccggagtgtccactgatccccaagcgtacaaggaatccaactatagctactgtctctcatctcggctccgggtgagtgcgacattctggcataatcctcggaaccactttcgatgccaagtgcagtttcatgggttgagcgaggaagacaagtggcccgagggcagtcctaaaccagtcactcaaaacataagcgccgaggcatggggtagagccgattgtgggattactagcgcttcataccaacaaggggtattgagcgctacaattctttacgaaattctcctcggcaaggcgacgctctacgccgtactggtgtctactctcgtggttatggcaatggtgaaacggaaaaacagctaatag

SEQ ID NO: 191 - DNA, 1800 bp, Artificial Sequence
  CT 552: pLenti 1 CEA TCR TRAV8-1*01 S112T 118P & 119T with murine constant region
atgcacagcctcctggggttgttgatggtgtcactgtggctgcaactgacaagggtgaatagtcaactagcagaagagaatccgtgggccctgagcgtccacgagggtgaaagtgtcacggtgaattgtagttacaagacatccataactgccctacagtggtacagacagaagtcaggcgaaggccctgcccagctaatcttaatacgttcaaatgagagagagaagcgcaatggaagactcagagccacccttgacacctccagccagagcagctccttgtccatcactgctactcggtgtgaagacaccgctgtgtacttctgtgctactgatctaaccaccggaggaaactacaaacctacgtttgggaaagggaccagcctcgtggttcatccagacattcagaaccccgaaccagccgtatatcagttgaaggacccaagatctcaggatagtacactctgtttgtttacggactttgactcacaaatcaacgtcccgaagactatggaaagtggtacgttcatcacagataagacggttctggacatgaaggctatggactcaaagagcaacggggcaattgcttggtccaaccagacaagctttacctgtcaggacatttttaaggagactaatgctacttatccctccagcgacgttccgtgtgatgcgactcttaccgagaagtcttttgagaccgatatgaatctcaacttccagaatctgtcagtgatgggtctgcggatcctgcttctgaaggttgcaggattcaatcttcttatgactctccggctctggtcttcaggttctggcgcgacgaattttagtttgcttaagcaagccggagatgtggaggaaaatcctggaccgatggctacaaggctcctctgttacacagtactttgtctcctgggtgcaagaattttgaactcaaaagtcattcagactccaagatatctggtgaaagggcaaggacaaaaagcaaagatgaggtgtatccctgaaaagggacatccagttgtattctggtatcaacaaaataagaacaatgagtttaaatttttgattaactttcagaatcaagaagttcttcagcaaatagacatgactgaaaaacgattctctgctgagtgtccttcaaactcaccttgcagcctagaaattcagtcctctgaggcaggagactcagcactgtacctctgtgccagcagtctgggactgggggactatgaacagtacttcggtcccggcaccaggctcacggttttagaggatctccggaacgtcaccccaccaaaggtcagtttgtttgagccatcaaaggcggagatcgccaacaaacagaaagctacgctcgtgtgtttggctcggggcttcttcccagaccacgtagaactttcctggtgggtcaatggaaaggaggttcattccggagtgtccactgatccccaagcgtacaaggaatccaactatagctactgtctctcatctcggctccgggtgagtgcgacattctggcataatcctcggaaccactttcgatgccaagtgcagtttcatgggttgagcgaggaagacaagtggcccgagggcagtcctaaaccagtcactcaaaacataagcgccgaggcatggggtagagccgattgtgggattactagcgcttcataccaacaaggggtattgagcgctacaattctttacgaaattctcctcggcaaggcgacgctctacgccgtactggtgtctactctcgtggttatggcaatggtgaaacggaaaaacagctaatag

SEQ ID NO: 192 - DNA, 1800 bp, Artificial Sequence
  CT 553: pLenti 1 CEA TCR TRAV8-1*01 L110F S112T 118P & 119T with murine constant region
atgcacagcctcctggggttgttgatggtgtcactgtggctgcaactgacaagggtgaatagtcaactagcagaagagaatccgtgggccctgagcgtccacgagggtgaaagtgtcacggtgaattgtagttacaagacatccataactgccctacagtggtacagacagaagtcaggcgaaggccctgcccagctaatcttaatacgttcaaatgagagagagaagcgcaatggaagactcagagccacccttgacacctccagccagagcagctccttgtccatcactgctactcggtgtgaagacaccgctgtgtacttctgtgctactgatttcaccaccggaggaaactacaaacctacgtttgggaaagggaccagcctcgtggttcatccagacattcagaaccccgaaccagccgtatatcagttgaaggacccaagatctcaggatagtacactctgtttgtttacggactttgactcacaaatcaacgtcccgaagactatggaaagtggtacgttcatcacagataagacggttctggacatgaaggctatggactcaaagagcaacggggcaattgcttggtccaaccagacaagctttacctgtcaggacatttttaaggagactaatgctacttatccctccagcgacgttccgtgtgatgcgactcttaccgagaagtcttttgagaccgatatgaatctcaacttccagaatctgtcagtgatgggtctgcggatcctgcttctgaaggttgcaggattcaatcttcttatgactctccggctctggtcttcaggttctggcgcgacgaattttagtttgcttaagcaagccggagatgtggaggaaaatcctggaccgatggctacaaggctcctctgttacacagtactttgtctcctgggtgcaagaattttgaactcaaaagtcattcagactccaagatatctggtgaaagggcaaggacaaaaagcaaagatgaggtgtatccctgaaaagggacatccagttgtattctggtatcaacaaaataagaacaatgagtttaaatttttgattaactttcagaatcaagaagttcttcagcaaatagacatgactgaaaaacgattctctgctgagtgtccttcaaactcaccttgcagcctagaaattcagtcctctgaggcaggagactcagcactgtacctctgtgccagcagtctgggactgggggactatgaacagtacttcggtcccggcaccaggctcacggttttagaggatctccggaacgtcaccccaccaaaggtcagtttgtttgagccatcaaaggcggagatcgccaacaaacagaaagctacgctcgtgtgtttggctcggggcttcttcccagaccacgtagaactttcctggtgggtcaatggaaaggaggttcattccggagtgtccactgatccccaagcgtacaaggaatccaactatagctactgtctctcatctcggctccgggtgagtgcgacattctggcataatcctcggaaccactttcgatgccaagtgcagtttcatgggttgagcgaggaagacaagtggcccgagggcagtcctaaaccagtcactcaaaacataagcgccgaggcatggggtagagccgattgtgggattactagcgcttcataccaacaaggggtattgagcgctacaattctttacgaaattctcctcggcaaggcgacgctctacgccgtactggtgtctactctcgtggttatggcaatggtgaaacggaaaaacagctaatag

SEQ ID NO: 193 - DNA, 1800 bp, Artificial Sequence
  CT 554: pLenti 1 CEA TCR TRAV8-1*01 L110F 118P & 119T TRBV26*01 L117T with murine constant region
atgcacagcctcctggggttgttgatggtgtcactgtggctgcaactgacaagggtgaatagtcaactagcagaagagaatccgtgggccctgagcgtccacgagggtgaaagtgtcacggtgaattgtagttacaagacatccataactgccctacagtggtacagacagaagtcaggcgaaggccctgcccagctaatcttaatacgttcaaatgagagagagaagcgcaatggaagactcagagccacccttgacacctccagccagagcagctccttgtccatcactgctactcggtgtgaagacaccgctgtgtacttctgtgctactgatttcacctcaggaggaaactacaaacctacgtttgggaaagggaccagcctcgtggttcatccagacattcagaaccccgaaccagccgtatatcagttgaaggacccaagatctcaggatagtacactctgtttgtttacggactttgactcacaaatcaacgtcccgaagactatggaaagtggtacgttcatcacagataagacggttctggacatgaaggctatggactcaaagagcaacggggcaattgcttggtccaaccagacaagctttacctgtcaggacatttttaaggagactaatgctacttatccctccagcgacgttccgtgtgatgcgactcttaccgagaagtcttttgagaccgatatgaatctcaacttccagaatctgtcagtgatgggtctgcggatcctgcttctgaaggttgcaggattcaatcttcttatgactctccggctctggtcttcaggttctggcgcgacgaattttagtttgcttaagcaagccggagatgtggaggaaaatcctggaccgatggctacaaggctcctctgttacacagtactttgtctcctgggtgcaagaattttgaactcaaaagtcattcagactccaagatatctggtgaaagggcaaggacaaaaagcaaagatgaggtgtatccctgaaaagggacatccagttgtattctggtatcaacaaaataagaacaatgagtttaaatttttgattaactttcagaatcaagaagttcttcagcaaatagacatgactgaaaaacgattctctgctgagtgtccttcaaactcaccttgcagcctagaaattcagtcctctgaggcaggagactcagcactgtacctctgtgccagcagtctggggacaggggactatgaacagtacttcggtcccggcaccaggctcacggttttagaggatctccggaacgtcaccccaccaaaggtcagtttgtttgagccatcaaaggcggagatcgccaacaaacagaaagctacgctcgtgtgtttggctcggggcttcttcccagaccacgtagaactttcctggtgggtcaatggaaaggaggttcattccggagtgtccactgatccccaagcgtacaaggaatccaactatagctactgtctctcatctcggctccgggtgagtgcgacattctggcataatcctcggaaccactttcgatgccaagtgcagtttcatgggttgagcgaggaagacaagtggcccgagggcagtcctaaaccagtcactcaaaacataagcgccgaggcatggggtagagccgattgtgggattactagcgcttcataccaacaaggggtattgagcgctacaattctttacgaaattctcctcggcaaggcgacgctctacgccgtactggtgtctactctcgtggttatggcaatggtgaaacggaaaaacagctaatag

SEQ ID NO: 194 - DNA, 1800 bp, Artificial Sequence
  CT 555: pLenti 1 CEA TCR TRAV8-1*01 S112T 118P & 119T TRBV26*01 L117T with murine constant region
atgcacagcctcctggggttgttgatggtgtcactgtggctgcaactgacaagggtgaatagtcaactagcagaagagaatccgtgggccctgagcgtccacgagggtgaaagtgtcacggtgaattgtagttacaagacatccataactgccctacagtggtacagacagaagtcaggcgaaggccctgcccagctaatcttaatacgttcaaatgagagagagaagcgcaatggaagactcagagccacccttgacacctccagccagagcagctccttgtccatcactgctactcggtgtgaagacaccgctgtgtacttctgtgctactgatctaaccaccggaggaaactacaaacctacgtttgggaaagggaccagcctcgtggttcatccagacattcagaaccccgaaccagccgtatatcagttgaaggacccaagatctcaggatagtacactctgtttgtttacggactttgactcacaaatcaacgtcccgaagactatggaaagtggtacgttcatcacagataagacggttctggacatgaaggctatggactcaaagagcaacggggcaattgcttggtccaaccagacaagctttacctgtcaggacatttttaaggagactaatgctacttatccctccagcgacgttccgtgtgatgcgactcttaccgagaagtcttttgagaccgatatgaatctcaacttccagaatctgtcagtgatgggtctgcggatcctgcttctgaaggttgcaggattcaatcttcttatgactctccggctctggtcttcaggttctggcgcgacgaattttagtttgcttaagcaagccggagatgtggaggaaaatcctggaccgatggctacaaggctcctctgttacacagtactttgtctcctgggtgcaagaattttgaactcaaaagtcattcagactccaagatatctggtgaaagggcaaggacaaaaagcaaagatgaggtgtatccctgaaaagggacatccagttgtattctggtatcaacaaaataagaacaatgagtttaaatttttgattaactttcagaatcaagaagttcttcagcaaatagacatgactgaaaaacgattctctgctgagtgtccttcaaactcaccttgcagcctagaaattcagtcctctgaggcaggagactcagcactgtacctctgtgccagcagtctggggacaggggactatgaacagtacttcggtcccggcaccaggctcacggttttagaggatctccggaacgtcaccccaccaaaggtcagtttgtttgagccatcaaaggcggagatcgccaacaaacagaaagctacgctcgtgtgtttggctcggggcttcttcccagaccacgtagaactttcctggtgggtcaatggaaaggaggttcattccggagtgtccactgatccccaagcgtacaaggaatccaactatagctactgtctctcatctcggctccgggtgagtgcgacattctggcataatcctcggaaccactttcgatgccaagtgcagtttcatgggttgagcgaggaagacaagtggcccgagggcagtcctaaaccagtcactcaaaacataagcgccgaggcatggggtagagccgattgtgggattactagcgcttcataccaacaaggggtattgagcgctacaattctttacgaaattctcctcggcaaggcgacgctctacgccgtactggtgtctactctcgtggttatggcaatggtgaaacggaaaaacagctaatag

SEQ ID NO: 195 - DNA, 1800 bp, Artificial Sequence
  CT 556: pLenti 1 CEA TCR TRAV8-1*01 L110F S112T 118P & 119T TRBV26*01 L117T with murine constant region
atgcacagcctcctggggttgttgatggtgtcactgtggctgcaactgacaagggtgaatagtcaactagcagaagagaatccgtgggccctgagcgtccacgagggtgaaagtgtcacggtgaattgtagttacaagacatccataactgccctacagtggtacagacagaagtcaggcgaaggccctgcccagctaatcttaatacgttcaaatgagagagagaagcgcaatggaagactcagagccacccttgacacctccagccagagcagctccttgtccatcactgctactcggtgtgaagacaccgctgtgtacttctgtgctactgatttcaccaccggaggaaactacaaacctacgtttgggaaagggaccagcctcgtggttcatccagacattcagaaccccgaaccagccgtatatcagttgaaggacccaagatctcaggatagtacactctgtttgtttacggactttgactcacaaatcaacgtcccgaagactatggaaagtggtacgttcatcacagataagacggttctggacatgaaggctatggactcaaagagcaacggggcaattgcttggtccaaccagacaagctttacctgtcaggacatttttaaggagactaatgctacttatccctccagcgacgttccgtgtgatgcgactcttaccgagaagtcttttgagaccgatatgaatctcaacttccagaatctgtcagtgatgggtctgcggatcctgcttctgaaggttgcaggattcaatcttcttatgactctccggctctggtcttcaggttctggcgcgacgaattttagtttgcttaagcaagccggagatgtggaggaaaatcctggaccgatggctacaaggctcctctgttacacagtactttgtctcctgggtgcaagaattttgaactcaaaagtcattcagactccaagatatctggtgaaagggcaaggacaaaaagcaaagatgaggtgtatccctgaaaagggacatccagttgtattctggtatcaacaaaataagaacaatgagtttaaatttttgattaactttcagaatcaagaagttcttcagcaaatagacatgactgaaaaacgattctctgctgagtgtccttcaaactcaccttgcagcctagaaattcagtcctctgaggcaggagactcagcactgtacctctgtgccagcagtctggggacaggggactatgaacagtacttcggtcccggcaccaggctcacggttttagaggatctccggaacgtcaccccaccaaaggtcagtttgtttgagccatcaaaggcggagatcgccaacaaacagaaagctacgctcgtgtgtttggctcggggcttcttcccagaccacgtagaactttcctggtgggtcaatggaaaggaggttcattccggagtgtccactgatccccaagcgtacaaggaatccaactatagctactgtctctcatctcggctccgggtgagtgcgacattctggcataatcctcggaaccactttcgatgccaagtgcagtttcatgggttgagcgaggaagacaagtggcccgagggcagtcctaaaccagtcactcaaaacataagcgccgaggcatggggtagagccgattgtgggattactagcgcttcataccaacaaggggtattgagcgctacaattctttacgaaattctcctcggcaaggcgacgctctacgccgtactggtgtctactctcgtggttatggcaatggtgaaacggaaaaacagctaatag

SEQ ID NO: 196 - DNA, 1800 bp, Artificial Sequence
  CT 557: pLenti 1 CEA TCR TRAV8-1*01 L110F 118P & 119T with murine constant region
atgcacagcctcctggggttgttgatggtgtcactgtggctgcaactgacaagggtgaatagtcaactagcagaagagaatccgtgggccctgagcgtccacgagggtgaaagtgtcacggtgaattgtagttacaagacatccataactgccctacagtggtacagacagaagtcaggcgaaggccctgcccagctaatcttaatacgttcaaatgagagagagaagcgcaatggaagactcagagccacccttgacacctccagccagagcagctccttgtccatcactgctactcggtgtgaagacaccgctgtgtacttctgtgctactgatttcacctcaggaggaaactacaaacctacgtttgggaaagggaccagcctcgtggttcatccaaatattcagaaccccgaaccagccgtatatcagttgaaggacccaagatctcaggatagtacactctgtttgtttacggactttgactcacaaatcaacgtcccgaagactatggaaagtggtacgttcatcacagataagtgcgttctggacatgaaggctatggactcaaagagcaacggggcaattgcttggtccaaccagacaagctttacctgtcaggacatttttaaggagactaatgctacttatccctccagcgacgttccgtgtgatgcgactcttaccgagaagtcttttgagaccgatatgaatctcaacttccagaatctgctggtgatcgttctgcggatcctgcttctgaaggttgcaggattcaatcttcttatgactctccggctctggtcttcaggttctggcgcgacgaattttagtttgcttaagcaagccggagatgtggaggaaaatcctggaccgatggctacaaggctcctctgttacacagtactttgtctcctgggtgcaagaattttgaactcaaaagtcattcagactccaagatatctggtgaaagggcaaggacaaaaagcaaagatgaggtgtatccctgaaaagggacatccagttgtattctggtatcaacaaaataagaacaatgagtttaaatttttgattaactttcagaatcaagaagttcttcagcaaatagacatgactgaaaaacgattctctgctgagtgtccttcaaactcaccttgcagcctagaaattcagtcctctgaggcaggagactcagcactgtacctctgtgccagcagtctgggactgggggactatgaacagtacttcggtcccggcaccaggctcacggttttagaggacctgcgcaacgtcaccccaccaaaggtcagtttgtttgagccatcaaaggcggagatcgccaacaaacagaaagctacgctcgtgtgtttggctcggggcttcttcccagaccacgtagaactttcctggtgggtcaatggaaaggaggttcattccggagtgtgcactgatccccaagcgtacaaggaatccaactatagctactgtctctcatctcggctccgggtgagtgcgacattctggcataatcctcggaaccactttcgatgccaagtgcagtttcatgggttgagcgaggaagacaagtggcccgagggcagtcctaaaccagtcactcaaaacataagcgccgaggcatggggtagagccgattgtgggattactagcgcttcataccaacaaggggtattgagcgctacaattctttacgaaattctcctcggcaaggcgacgctctacgccgtactggtgtctactctcgtggttatggcaatggtgaaacggaaaaacagctaatag

SEQ ID NO: 197 - DNA, 1800 bp, Artificial Sequence
  CT 558: pLenti 1 CEA TCR TRAV8-1*01 S112T 118P & 119T with murine constant region
atgcacagcctcctggggttgttgatggtgtcactgtggctgcaactgacaagggtgaatagtcaactagcagaagagaatccgtgggccctgagcgtccacgagggtgaaagtgtcacggtgaattgtagttacaagacatccataactgccctacagtggtacagacagaagtcaggcgaaggccctgcccagctaatcttaatacgttcaaatgagagagagaagcgcaatggaagactcagagccacccttgacacctccagccagagcagctccttgtccatcactgctactcggtgtgaagacaccgctgtgtacttctgtgctactgatctaaccaccggaggaaactacaaacctacgtttgggaaagggaccagcctcgtggttcatccaaatattcagaaccccgaaccagccgtatatcagttgaaggacccaagatctcaggatagtacactctgtttgtttacggactttgactcacaaatcaacgtcccgaagactatggaaagtggtacgttcatcacagataagtgcgttctggacatgaaggctatggactcaaagagcaacggggcaattgcttggtccaaccagacaagctttacctgtcaggacatttttaaggagactaatgctacttatccctccagcgacgttccgtgtgatgcgactcttaccgagaagtcttttgagaccgatatgaatctcaacttccagaatctgctggtgatcgttctgcggatcctgcttctgaaggttgcaggattcaatcttcttatgactctccggctctggtcttcaggttctggcgcgacgaattttagtttgcttaagcaagccggagatgtggaggaaaatcctggaccgatggctacaaggctcctctgttacacagtactttgtctcctgggtgcaagaattttgaactcaaaagtcattcagactccaagatatctggtgaaagggcaaggacaaaaagcaaagatgaggtgtatccctgaaaagggacatccagttgtattctggtatcaacaaaataagaacaatgagtttaaatttttgattaactttcagaatcaagaagttcttcagcaaatagacatgactgaaaaacgattctctgctgagtgtccttcaaactcaccttgcagcctagaaattcagtcctctgaggcaggagactcagcactgtacctctgtgccagcagtctgggactgggggactatgaacagtacttcggtcccggcaccaggctcacggttttagaggacctgcgcaacgtcaccccaccaaaggtcagtttgtttgagccatcaaaggcggagatcgccaacaaacagaaagctacgctcgtgtgtttggctcggggcttcttcccagaccacgtagaactttcctggtgggtcaatggaaaggaggttcattccggagtgtgcactgatccccaagcgtacaaggaatccaactatagctactgtctctcatctcggctccgggtgagtgcgacattctggcataatcctcggaaccactttcgatgccaagtgcagtttcatgggttgagcgaggaagacaagtggcccgagggcagtcctaaaccagtcactcaaaacataagcgccgaggcatggggtagagccgattgtgggattactagcgcttcataccaacaaggggtattgagcgctacaattctttacgaaattctcctcggcaaggcgacgctctacgccgtactggtgtctactctcgtggttatggcaatggtgaaacggaaaaacagctaatag

SEQ ID NO: 198 - DNA, 1800 bp, Artificial Sequence
  CT 559: pLenti 1 CEA TCR TRAV8-1*01 L110F S112T 118P & 119T with murine constant region
atgcacagcctcctggggttgttgatggtgtcactgtggctgcaactgacaagggtgaatagtcaactagcagaagagaatccgtgggccctgagcgtccacgagggtgaaagtgtcacggtgaattgtagttacaagacatccataactgccctacagtggtacagacagaagtcaggcgaaggccctgcccagctaatcttaatacgttcaaatgagagagagaagcgcaatggaagactcagagccacccttgacacctccagccagagcagctccttgtccatcactgctactcggtgtgaagacaccgctgtgtacttctgtgctactgatttcaccaccggaggaaactacaaacctacgtttgggaaagggaccagcctcgtggttcatccaaatattcagaaccccgaaccagccgtatatcagttgaaggacccaagatctcaggatagtacactctgtttgtttacggactttgactcacaaatcaacgtcccgaagactatggaaagtggtacgttcatcacagataagtgcgttctggacatgaaggctatggactcaaagagcaacggggcaattgcttggtccaaccagacaagctttacctgtcaggacatttttaaggagactaatgctacttatccctccagcgacgttccgtgtgatgcgactcttaccgagaagtcttttgagaccgatatgaatctcaacttccagaatctgctggtgatcgttctgcggatcctgcttctgaaggttgcaggattcaatcttcttatgactctccggctctggtcttcaggttctggcgcgacgaattttagtttgcttaagcaagccggagatgtggaggaaaatcctggaccgatggctacaaggctcctctgttacacagtactttgtctcctgggtgcaagaattttgaactcaaaagtcattcagactccaagatatctggtgaaagggcaaggacaaaaagcaaagatgaggtgtatccctgaaaagggacatccagttgtattctggtatcaacaaaataagaacaatgagtttaaatttttgattaactttcagaatcaagaagttcttcagcaaatagacatgactgaaaaacgattctctgctgagtgtccttcaaactcaccttgcagcctagaaattcagtcctctgaggcaggagactcagcactgtacctctgtgccagcagtctgggactgggggactatgaacagtacttcggtcccggcaccaggctcacggttttagaggacctgcgcaacgtcaccccaccaaaggtcagtttgtttgagccatcaaaggcggagatcgccaacaaacagaaagctacgctcgtgtgtttggctcggggcttcttcccagaccacgtagaactttcctggtgggtcaatggaaaggaggttcattccggagtgtgcactgatccccaagcgtacaaggaatccaactatagctactgtctctcatctcggctccgggtgagtgcgacattctggcataatcctcggaaccactttcgatgccaagtgcagtttcatgggttgagcgaggaagacaagtggcccgagggcagtcctaaaccagtcactcaaaacataagcgccgaggcatggggtagagccgattgtgggattactagcgcttcataccaacaaggggtattgagcgctacaattctttacgaaattctcctcggcaaggcgacgctctacgccgtactggtgtctactctcgtggttatggcaatggtgaaacggaaaaacagctaatag

SEQ ID NO: 199 - DNA, 1800 bp, Artificial Sequence
  CT 560: pLenti 1 CEA TCR TRAV8-1*01 118P & 119T TRBV26*01 L117T with murine constant region
atgcacagcctcctggggttgttgatggtgtcactgtggctgcaactgacaagggtgaatagtcaactagcagaagagaatccgtgggccctgagcgtccacgagggtgaaagtgtcacggtgaattgtagttacaagacatccataactgccctacagtggtacagacagaagtcaggcgaaggccctgcccagctaatcttaatacgttcaaatgagagagagaagcgcaatggaagactcagagccacccttgacacctccagccagagcagctccttgtccatcactgctactcggtgtgaagacaccgctgtgtacttctgtgctactgatctaacctcaggaggaaactacaaacctacgtttgggaaagggaccagcctcgtggttcatccaaatattcagaaccccgaaccagccgtatatcagttgaaggacccaagatctcaggatagtacactctgtttgtttacggactttgactcacaaatcaacgtcccgaagactatggaaagtggtacgttcatcacagataagtgcgttctggacatgaaggctatggactcaaagagcaacggggcaattgcttggtccaaccagacaagctttacctgtcaggacatttttaaggagactaatgctacttatccctccagcgacgttccgtgtgatgcgactcttaccgagaagtcttttgagaccgatatgaatctcaacttccagaatctgctggtgatcgttctgcggatcctgcttctgaaggttgcaggattcaatcttcttatgactctccggctctggtcttcaggttctggcgcgacgaattttagtttgcttaagcaagccggagatgtggaggaaaatcctggaccgatggctacaaggctcctctgttacacagtactttgtctcctgggtgcaagaattttgaactcaaaagtcattcagactccaagatatctggtgaaagggcaaggacaaaaagcaaagatgaggtgtatccctgaaaagggacatccagttgtattctggtatcaacaaaataagaacaatgagtttaaatttttgattaactttcagaatcaagaagttcttcagcaaatagacatgactgaaaaacgattctctgctgagtgtccttcaaactcaccttgcagcctagaaattcagtcctctgaggcaggagactcagcactgtacctctgtgccagcagtctggggacaggggactatgaacagtacttcggtcccggcaccaggctcacggttttagaggacctgcgcaacgtcaccccaccaaaggtcagtttgtttgagccatcaaaggcggagatcgccaacaaacagaaagctacgctcgtgtgtttggctcggggcttcttcccagaccacgtagaactttcctggtgggtcaatggaaaggaggttcattccggagtgtgcactgatccccaagcgtacaaggaatccaactatagctactgtctctcatctcggctccgggtgagtgcgacattctggcataatcctcggaaccactttcgatgccaagtgcagtttcatgggttgagcgaggaagacaagtggcccgagggcagtcctaaaccagtcactcaaaacataagcgccgaggcatggggtagagccgattgtgggattactagcgcttcataccaacaaggggtattgagcgctacaattctttacgaaattctcctcggcaaggcgacgctctacgccgtactggtgtctactctcgtggttatggcaatggtgaaacggaaaaacagctaatag

SEQ ID NO: 200 - DNA, 1800 bp, Artificial Sequence
  CT 561: pLenti 1 CEA TCR TRAV8-1*01 L110F 118P & 119T TRBV26*01 L117T with murine constant region
atgcacagcctcctggggttgttgatggtgtcactgtggctgcaactgacaagggtgaatagtcaactagcagaagagaatccgtgggccctgagcgtccacgagggtgaaagtgtcacggtgaattgtagttacaagacatccataactgccctacagtggtacagacagaagtcaggcgaaggccctgcccagctaatcttaatacgttcaaatgagagagagaagcgcaatggaagactcagagccacccttgacacctccagccagagcagctccttgtccatcactgctactcggtgtgaagacaccgctgtgtacttctgtgctactgatttcacctcaggaggaaactacaaacctacgtttgggaaagggaccagcctcgtggttcatccaaatattcagaaccccgaaccagccgtatatcagttgaaggacccaagatctcaggatagtacactctgtttgtttacggactttgactcacaaatcaacgtcccgaagactatggaaagtggtacgttcatcacagataagtgcgttctggacatgaaggctatggactcaaagagcaacggggcaattgcttggtccaaccagacaagctttacctgtcaggacatttttaaggagactaatgctacttatccctccagcgacgttccgtgtgatgcgactcttaccgagaagtcttttgagaccgatatgaatctcaacttccagaatctgctggtgatcgttctgcggatcctgcttctgaaggttgcaggattcaatcttcttatgactctccggctctggtcttcaggttctggcgcgacgaattttagtttgcttaagcaagccggagatgtggaggaaaatcctggaccgatggctacaaggctcctctgttacacagtactttgtctcctgggtgcaagaattttgaactcaaaagtcattcagactccaagatatctggtgaaagggcaaggacaaaaagcaaagatgaggtgtatccctgaaaagggacatccagttgtattctggtatcaacaaaataagaacaatgagtttaaatttttgattaactttcagaatcaagaagttcttcagcaaatagacatgactgaaaaacgattctctgctgagtgtccttcaaactcaccttgcagcctagaaattcagtcctctgaggcaggagactcagcactgtacctctgtgccagcagtctggggacaggggactatgaacagtacttcggtcccggcaccaggctcacggttttagaggacctgcgcaacgtcaccccaccaaaggtcagtttgtttgagccatcaaaggcggagatcgccaacaaacagaaagctacgctcgtgtgtttggctcggggcttcttcccagaccacgtagaactttcctggtgggtcaatggaaaggaggttcattccggagtgtgcactgatccccaagcgtacaaggaatccaactatagctactgtctctcatctcggctccgggtgagtgcgacattctggcataatcctcggaaccactttcgatgccaagtgcagtttcatgggttgagcgaggaagacaagtggcccgagggcagtcctaaaccagtcactcaaaacataagcgccgaggcatggggtagagccgattgtgggattactagcgcttcataccaacaaggggtattgagcgctacaattctttacgaaattctcctcggcaaggcgacgctctacgccgtactggtgtctactctcgtggttatggcaatggtgaaacggaaaaacagctaatag

SEQ ID NO: 201 - DNA, 1800 bp, Artificial Sequence
  CT 562: pLenti 1 CEA TCR TRAV8-1*01 S112T 118P & 119T TRBV26*01 L117T with murine constant region
atgcacagcctcctggggttgttgatggtgtcactgtggctgcaactgacaagggtgaatagtcaactagcagaagagaatccgtgggccctgagcgtccacgagggtgaaagtgtcacggtgaattgtagttacaagacatccataactgccctacagtggtacagacagaagtcaggcgaaggccctgcccagctaatcttaatacgttcaaatgagagagagaagcgcaatggaagactcagagccacccttgacacctccagccagagcagctccttgtccatcactgctactcggtgtgaagacaccgctgtgtacttctgtgctactgatctaaccaccggaggaaactacaaacctacgtttgggaaagggaccagcctcgtggttcatccaaatattcagaaccccgaaccagccgtatatcagttgaaggacccaagatctcaggatagtacactctgtttgtttacggactttgactcacaaatcaacgtcccgaagactatggaaagtggtacgttcatcacagataagtgcgttctggacatgaaggctatggactcaaagagcaacggggcaattgcttggtccaaccagacaagctttacctgtcaggacatttttaaggagactaatgctacttatccctccagcgacgttccgtgtgatgcgactcttaccgagaagtcttttgagaccgatatgaatctcaacttccagaatctgctggtgatcgttctgcggatcctgcttctgaaggttgcaggattcaatcttcttatgactctccggctctggtcttcaggttctggcgcgacgaattttagtttgcttaagcaagccggagatgtggaggaaaatcctggaccgatggctacaaggctcctctgttacacagtactttgtctcctgggtgcaagaattttgaactcaaaagtcattcagactccaagatatctggtgaaagggcaaggacaaaaagcaaagatgaggtgtatccctgaaaagggacatccagttgtattctggtatcaacaaaataagaacaatgagtttaaatttttgattaactttcagaatcaagaagttcttcagcaaatagacatgactgaaaaacgattctctgctgagtgtccttcaaactcaccttgcagcctagaaattcagtcctctgaggcaggagactcagcactgtacctctgtgccagcagtctggggacaggggactatgaacagtacttcggtcccggcaccaggctcacggttttagaggacctgcgcaacgtcaccccaccaaaggtcagtttgtttgagccatcaaaggcggagatcgccaacaaacagaaagctacgctcgtgtgtttggctcggggcttcttcccagaccacgtagaactttcctggtgggtcaatggaaaggaggttcattccggagtgtgcactgatccccaagcgtacaaggaatccaactatagctactgtctctcatctcggctccgggtgagtgcgacattctggcataatcctcggaaccactttcgatgccaagtgcagtttcatgggttgagcgaggaagacaagtggcccgagggcagtcctaaaccagtcactcaaaacataagcgccgaggcatggggtagagccgattgtgggattactagcgcttcataccaacaaggggtattgagcgctacaattctttacgaaattctcctcggcaaggcgacgctctacgccgtactggtgtctactctcgtggttatggcaatggtgaaacggaaaaacagctaatag

SEQ ID NO: 202 - DNA, 1800 bp, Artificial Sequence
  CT 563: pLenti 1 CEA TCR TRAV8-1*01 L110F S112T 118P & 119T TRBV26*01 L117T with murine constant region
atgcacagcctcctggggttgttgatggtgtcactgtggctgcaactgacaagggtgaatagtcaactagcagaagagaatccgtgggccctgagcgtccacgagggtgaaagtgtcacggtgaattgtagttacaagacatccataactgccctacagtggtacagacagaagtcaggcgaaggccctgcccagctaatcttaatacgttcaaatgagagagagaagcgcaatggaagactcagagccacccttgacacctccagccagagcagctccttgtccatcactgctactcggtgtgaagacaccgctgtgtacttctgtgctactgatttcaccaccggaggaaactacaaacctacgtttgggaaagggaccagcctcgtggttcatccaaatattcagaaccccgaaccagccgtatatcagttgaaggacccaagatctcaggatagtacactctgtttgtttacggactttgactcacaaatcaacgtcccgaagactatggaaagtggtacgttcatcacagataagtgcgttctggacatgaaggctatggactcaaagagcaacggggcaattgcttggtccaaccagacaagctttacctgtcaggacatttttaaggagactaatgctacttatccctccagcgacgttccgtgtgatgcgactcttaccgagaagtcttttgagaccgatatgaatctcaacttccagaatctgctggtgatcgttctgcggatcctgcttctgaaggttgcaggattcaatcttcttatgactctccggctctggtcttcaggttctggcgcgacgaattttagtttgcttaagcaagccggagatgtggaggaaaatcctggaccgatggctacaaggctcctctgttacacagtactttgtctcctgggtgcaagaattttgaactcaaaagtcattcagactccaagatatctggtgaaagggcaaggacaaaaagcaaagatgaggtgtatccctgaaaagggacatccagttgtattctggtatcaacaaaataagaacaatgagtttaaatttttgattaactttcagaatcaagaagttcttcagcaaatagacatgactgaaaaacgattctctgctgagtgtccttcaaactcaccttgcagcctagaaattcagtcctctgaggcaggagactcagcactgtacctctgtgccagcagtctggggacaggggactatgaacagtacttcggtcccggcaccaggctcacggttttagaggacctgcgcaacgtcaccccaccaaaggtcagtttgtttgagccatcaaaggcggagatcgccaacaaacagaaagctacgctcgtgtgtttggctcggggcttcttcccagaccacgtagaactttcctggtgggtcaatggaaaggaggttcattccggagtgtgcactgatccccaagcgtacaaggaatccaactatagctactgtctctcatctcggctccgggtgagtgcgacattctggcataatcctcggaaccactttcgatgccaagtgcagtttcatgggttgagcgaggaagacaagtggcccgagggcagtcctaaaccagtcactcaaaacataagcgccgaggcatggggtagagccgattgtgggattactagcgcttcataccaacaaggggtattgagcgctacaattctttacgaaattctcctcggcaaggcgacgctctacgccgtactggtgtctactctcgtggttatggcaatggtgaaacggaaaaacagctaatag

SEQ ID NO: 203 - DNA, 1794 bp, Artificial Sequence
  CT 532: pLenti 1 CEA TCR TRAV8-1*01 TRBV26*01 with regular murine constant region
atgcacagcctcctggggttgttgatggtgtcactgtggctgcaactgacaagggtgaatagtcaactagcagaagagaatccgtgggccctgagcgtccacgagggtgaaagtgtcacggtgaattgtagttacaagacatccataactgccctacagtggtacagacagaagtcaggcgaaggccctgcccagctaatcttaatacgttcaaatgagagagagaagcgcaatggaagactcagagccacccttgacacctccagccagagcagctccttgtccatcactgctactcggtgtgaagacaccgctgtgtacttctgtgctactgatctaacctcaggaggaaactacaaatttgggaaagggaccagcctcgtggttcatccagacattcagaaccccgaaccagccgtatatcagttgaaggacccaagatctcaggatagtacactctgtttgtttacggactttgactcacaaatcaacgtcccgaagactatggaaagtggtacgttcatcacagataagacggttctggacatgaaggctatggactcaaagagcaacggggcaattgcttggtccaaccagacaagctttacctgtcaggacatttttaaggagactaatgctacttatccctccagcgacgttccgtgtgatgcgactcttaccgagaagtcttttgagaccgatatgaatctcaacttccagaatctgtcagtgatgggtctgcggatcctgcttctgaaggttgcaggattcaatcttcttatgactctccggctctggtcttcaggttctggcgcgacgaattttagtttgcttaagcaagccggagatgtggaggaaaatcctggaccgatggctacaaggctcctctgttacacagtactttgtctcctgggtgcaagaattttgaactcaaaagtcattcagactccaagatatctggtgaaagggcaaggacaaaaagcaaagatgaggtgtatccctgaaaagggacatccagttgtattctggtatcaacaaaataagaacaatgagtttaaatttttgattaactttcagaatcaagaagttcttcagcaaatagacatgactgaaaaacgattctctgctgagtgtccttcaaactcaccttgcagcctagaaattcagtcctctgaggcaggagactcagcactgtacctctgtgccagcagtctgggactgggggactatgaacagtacttcggtcccggcaccaggctcacggttttagaggatctccggaacgtcaccccaccaaaggtcagtttgtttgagccatcaaaggcggagatcgccaacaaacagaaagctacgctcgtgtgtttggctcggggcttcttcccagaccacgtagaactttcctggtgggtcaatggaaaggaggttcattccggagtgtccactgatccccaagcgtacaaggaatccaactatagctactgtctctcatctcggctccgggtgagtgcgacattctggcataatcctcggaaccactttcgatgccaagtgcagtttcatgggttgagcgaggaagacaagtggcccgagggcagtcctaaaccagtcactcaaaacataagcgccgaggcatggggtagagccgattgtgggattactagcgcttcataccaacaaggggtattgagcgctacaattctttacgaaattctcctcggcaaggcgacgctctacgccgtactggtgtctactctcgtggttatggcaatggtgaaacggaaaaacagctaatag

SEQ ID NO: 204 - DNA, 1794 bp, Artificial Sequence
  CT 533: pLenti 1 CEA TCR TRAV8-1*01 TRBV26*01 L117T with regular murine constant region
atgcacagcctcctggggttgttgatggtgtcactgtggctgcaactgacaagggtgaatagtcaactagcagaagagaatccgtgggccctgagcgtccacgagggtgaaagtgtcacggtgaattgtagttacaagacatccataactgccctacagtggtacagacagaagtcaggcgaaggccctgcccagctaatcttaatacgttcaaatgagagagagaagcgcaatggaagactcagagccacccttgacacctccagccagagcagctccttgtccatcactgctactcggtgtgaagacaccgctgtgtacttctgtgctactgatctaacctcaggaggaaactacaaatttgggaaagggaccagcctcgtggttcatccagacattcagaaccccgaaccagccgtatatcagttgaaggacccaagatctcaggatagtacactctgtttgtttacggactttgactcacaaatcaacgtcccgaagactatggaaagtggtacgttcatcacagataagacggttctggacatgaaggctatggactcaaagagcaacggggcaattgcttggtccaaccagacaagctttacctgtcaggacatttttaaggagactaatgctacttatccctccagcgacgttccgtgtgatgcgactcttaccgagaagtcttttgagaccgatatgaatctcaacttccagaatctgtcagtgatgggtctgcggatcctgcttctgaaggttgcaggattcaatcttcttatgactctccggctctggtcttcaggttctggcgcgacgaattttagtttgcttaagcaagccggagatgtggaggaaaatcctggaccgatggctacaaggctcctctgttacacagtactttgtctcctgggtgcaagaattttgaactcaaaagtcattcagactccaagatatctggtgaaagggcaaggacaaaaagcaaagatgaggtgtatccctgaaaagggacatccagttgtattctggtatcaacaaaataagaacaatgagtttaaatttttgattaactttcagaatcaagaagttcttcagcaaatagacatgactgaaaaacgattctctgctgagtgtccttcaaactcaccttgcagcctagaaattcagtcctctgaggcaggagactcagcactgtacctctgtgccagcagtctggggacaggggactatgaacagtacttcggtcccggcaccaggctcacggttttagaggatctccggaacgtcaccccaccaaaggtcagtttgtttgagccatcaaaggcggagatcgccaacaaacagaaagctacgctcgtgtgtttggctcggggcttcttcccagaccacgtagaactttcctggtgggtcaatggaaaggaggttcattccggagtgtccactgatccccaagcgtacaaggaatccaactatagctactgtctctcatctcggctccgggtgagtgcgacattctggcataatcctcggaaccactttcgatgccaagtgcagtttcatgggttgagcgaggaagacaagtggcccgagggcagtcctaaaccagtcactcaaaacataagcgccgaggcatggggtagagccgattgtgggattactagcgcttcataccaacaaggggtattgagcgctacaattctttacgaaattctcctcggcaaggcgacgctctacgccgtactggtgtctactctcgtggttatggcaatggtgaaacggaaaaacagctaatag

SEQ ID NO: 205 - DNA, 1794 bp, Artificial Sequence
  CT 534: pLenti 1 CEA TCR TRAV8-1*01 TRBV26*01 murine constant region (no PT)
atgcacagcctcctggggttgttgatggtgtcactgtggctgcaactgacaagggtgaatagtcaactagcagaagagaatccgtgggccctgagcgtccacgagggtgaaagtgtcacggtgaattgtagttacaagacatccataactgccctacagtggtacagacagaagtcaggcgaaggccctgcccagctaatcttaatacgttcaaatgagagagagaagcgcaatggaagactcagagccacccttgacacctccagccagagcagctccttgtccatcactgctactcggtgtgaagacaccgctgtgtacttctgtgctactgatctaacctcaggaggaaactacaaatttgggaaagggaccagcctcgtggttcatccaaatattcagaaccccgaaccagccgtatatcagttgaaggacccaagatctcaggatagtacactctgtttgtttacggactttgactcacaaatcaacgtcccgaagactatggaaagtggtacgttcatcacagataagtgcgttctggacatgaaggctatggactcaaagagcaacggggcaattgcttggtccaaccagacaagctttacctgtcaggacatttttaaggagactaatgctacttatccctccagcgacgttccgtgtgatgcgactcttaccgagaagtcttttgagaccgatatgaatctcaacttccagaatctgctggtgatcgttctgcggatcctgcttctgaaggttgcaggattcaatcttcttatgactctccggctctggtcttcaggttctggcgcgacgaattttagtttgcttaagcaagccggagatgtggaggaaaatcctggaccgatggctacaaggctcctctgttacacagtactttgtctcctgggtgcaagaattttgaactcaaaagtcattcagactccaagatatctggtgaaagggcaaggacaaaaagcaaagatgaggtgtatccctgaaaagggacatccagttgtattctggtatcaacaaaataagaacaatgagtttaaatttttgattaactttcagaatcaagaagttcttcagcaaatagacatgactgaaaaacgattctctgctgagtgtccttcaaactcaccttgcagcctagaaattcagtcctctgaggcaggagactcagcactgtacctctgtgccagcagtctgggactgggggactatgaacagtacttcggtcccggcaccaggctcacggttttagaggacctgcgcaacgtcaccccaccaaaggtcagtttgtttgagccatcaaaggcggagatcgccaacaaacagaaagctacgctcgtgtgtttggctcggggcttcttcccagaccacgtagaactttcctggtgggtcaatggaaaggaggttcattccggagtgtgcactgatccccaagcgtacaaggaatccaactatagctactgtctctcatctcggctccgggtgagtgcgacattctggcataatcctcggaaccactttcgatgccaagtgcagtttcatgggttgagcgaggaagacaagtggcccgagggcagtcctaaaccagtcactcaaaacataagcgccgaggcatggggtagagccgattgtgggattactagcgcttcataccaacaaggggtattgagcgctacaattctttacgaaattctcctcggcaaggcgacgctctacgccgtactggtgtctactctcgtggttatggcaatggtgaaacggaaaaacagctaatag

SEQ ID NO: 206 - DNA, 1794 bp, Artificial Sequence
  CT 535: pLenti 1 CEA TCR TRAV8-1*01 L110F TRBV26*01 with regular murine constant region
atgcacagcctcctggggttgttgatggtgtcactgtggctgcaactgacaagggtgaatagtcaactagcagaagagaatccgtgggccctgagcgtccacgagggtgaaagtgtcacggtgaattgtagttacaagacatccataactgccctacagtggtacagacagaagtcaggcgaaggccctgcccagctaatcttaatacgttcaaatgagagagagaagcgcaatggaagactcagagccacccttgacacctccagccagagcagctccttgtccatcactgctactcggtgtgaagacaccgctgtgtacttctgtgctactgatttcacctcaggaggaaactacaaatttgggaaagggaccagcctcgtggttcatccagacattcagaaccccgaaccagccgtatatcagttgaaggacccaagatctcaggatagtacactctgtttgtttacggactttgactcacaaatcaacgtcccgaagactatggaaagtggtacgttcatcacagataagacggttctggacatgaaggctatggactcaaagagcaacggggcaattgcttggtccaaccagacaagctttacctgtcaggacatttttaaggagactaatgctacttatccctccagcgacgttccgtgtgatgcgactcttaccgagaagtcttttgagaccgatatgaatctcaacttccagaatctgtcagtgatgggtctgcggatcctgcttctgaaggttgcaggattcaatcttcttatgactctccggctctggtcttcaggttctggcgcgacgaattttagtttgcttaagcaagccggagatgtggaggaaaatcctggaccgatggctacaaggctcctctgttacacagtactttgtctcctgggtgcaagaattttgaactcaaaagtcattcagactccaagatatctggtgaaagggcaaggacaaaaagcaaagatgaggtgtatccctgaaaagggacatccagttgtattctggtatcaacaaaataagaacaatgagtttaaatttttgattaactttcagaatcaagaagttcttcagcaaatagacatgactgaaaaacgattctctgctgagtgtccttcaaactcaccttgcagcctagaaattcagtcctctgaggcaggagactcagcactgtacctctgtgccagcagtctgggactgggggactatgaacagtacttcggtcccggcaccaggctcacggttttagaggatctccggaacgtcaccccaccaaaggtcagtttgtttgagccatcaaaggcggagatcgccaacaaacagaaagctacgctcgtgtgtttggctcggggcttcttcccagaccacgtagaactttcctggtgggtcaatggaaaggaggttcattccggagtgtccactgatccccaagcgtacaaggaatccaactatagctactgtctctcatctcggctccgggtgagtgcgacattctggcataatcctcggaaccactttcgatgccaagtgcagtttcatgggttgagcgaggaagacaagtggcccgagggcagtcctaaaccagtcactcaaaacataagcgccgaggcatggggtagagccgattgtgggattactagcgcttcataccaacaaggggtattgagcgctacaattctttacgaaattctcctcggcaaggcgacgctctacgccgtactggtgtctactctcgtggttatggcaatggtgaaacggaaaaacagctaatag

SEQ ID NO: 207 - DNA, 1794 bp, Artificial Sequence
  CT 536: pLenti 1 CEA TCR TRAV8-1*01 S112T  TRBV26*01 with regular murine constant region
atgcacagcctcctggggttgttgatggtgtcactgtggctgcaactgacaagggtgaatagtcaactagcagaagagaatccgtgggccctgagcgtccacgagggtgaaagtgtcacggtgaattgtagttacaagacatccataactgccctacagtggtacagacagaagtcaggcgaaggccctgcccagctaatcttaatacgttcaaatgagagagagaagcgcaatggaagactcagagccacccttgacacctccagccagagcagctccttgtccatcactgctactcggtgtgaagacaccgctgtgtacttctgtgctactgatctaaccaccggaggaaactacaaatttgggaaagggaccagcctcgtggttcatccagacattcagaaccccgaaccagccgtatatcagttgaaggacccaagatctcaggatagtacactctgtttgtttacggactttgactcacaaatcaacgtcccgaagactatggaaagtggtacgttcatcacagataagacggttctggacatgaaggctatggactcaaagagcaacggggcaattgcttggtccaaccagacaagctttacctgtcaggacatttttaaggagactaatgctacttatccctccagcgacgttccgtgtgatgcgactcttaccgagaagtcttttgagaccgatatgaatctcaacttccagaatctgtcagtgatgggtctgcggatcctgcttctgaaggttgcaggattcaatcttcttatgactctccggctctggtcttcaggttctggcgcgacgaattttagtttgcttaagcaagccggagatgtggaggaaaatcctggaccgatggctacaaggctcctctgttacacagtactttgtctcctgggtgcaagaattttgaactcaaaagtcattcagactccaagatatctggtgaaagggcaaggacaaaaagcaaagatgaggtgtatccctgaaaagggacatccagttgtattctggtatcaacaaaataagaacaatgagtttaaatttttgattaactttcagaatcaagaagttcttcagcaaatagacatgactgaaaaacgattctctgctgagtgtccttcaaactcaccttgcagcctagaaattcagtcctctgaggcaggagactcagcactgtacctctgtgccagcagtctgggactgggggactatgaacagtacttcggtcccggcaccaggctcacggttttagaggatctccggaacgtcaccccaccaaaggtcagtttgtttgagccatcaaaggcggagatcgccaacaaacagaaagctacgctcgtgtgtttggctcggggcttcttcccagaccacgtagaactttcctggtgggtcaatggaaaggaggttcattccggagtgtccactgatccccaagcgtacaaggaatccaactatagctactgtctctcatctcggctccgggtgagtgcgacattctggcataatcctcggaaccactttcgatgccaagtgcagtttcatgggttgagcgaggaagacaagtggcccgagggcagtcctaaaccagtcactcaaaacataagcgccgaggcatggggtagagccgattgtgggattactagcgcttcataccaacaaggggtattgagcgctacaattctttacgaaattctcctcggcaaggcgacgctctacgccgtactggtgtctactctcgtggttatggcaatggtgaaacggaaaaacagctaatag

SEQ ID NO: 208 - DNA, 1794 bp, Artificial Sequence
  CT 537: pLenti 1 CEA TCR TRAV8-1*01 L110F & S112T TRBV26*01 with regular murine constant region
atgcacagcctcctggggttgttgatggtgtcactgtggctgcaactgacaagggtgaatagtcaactagcagaagagaatccgtgggccctgagcgtccacgagggtgaaagtgtcacggtgaattgtagttacaagacatccataactgccctacagtggtacagacagaagtcaggcgaaggccctgcccagctaatcttaatacgttcaaatgagagagagaagcgcaatggaagactcagagccacccttgacacctccagccagagcagctccttgtccatcactgctactcggtgtgaagacaccgctgtgtacttctgtgctactgatttcaccaccggaggaaactacaaatttgggaaagggaccagcctcgtggttcatccagacattcagaaccccgaaccagccgtatatcagttgaaggacccaagatctcaggatagtacactctgtttgtttacggactttgactcacaaatcaacgtcccgaagactatggaaagtggtacgttcatcacagataagacggttctggacatgaaggctatggactcaaagagcaacggggcaattgcttggtccaaccagacaagctttacctgtcaggacatttttaaggagactaatgctacttatccctccagcgacgttccgtgtgatgcgactcttaccgagaagtcttttgagaccgatatgaatctcaacttccagaatctgtcagtgatgggtctgcggatcctgcttctgaaggttgcaggattcaatcttcttatgactctccggctctggtcttcaggttctggcgcgacgaattttagtttgcttaagcaagccggagatgtggaggaaaatcctggaccgatggctacaaggctcctctgttacacagtactttgtctcctgggtgcaagaattttgaactcaaaagtcattcagactccaagatatctggtgaaagggcaaggacaaaaagcaaagatgaggtgtatccctgaaaagggacatccagttgtattctggtatcaacaaaataagaacaatgagtttaaatttttgattaactttcagaatcaagaagttcttcagcaaatagacatgactgaaaaacgattctctgctgagtgtccttcaaactcaccttgcagcctagaaattcagtcctctgaggcaggagactcagcactgtacctctgtgccagcagtctgggactgggggactatgaacagtacttcggtcccggcaccaggctcacggttttagaggatctccggaacgtcaccccaccaaaggtcagtttgtttgagccatcaaaggcggagatcgccaacaaacagaaagctacgctcgtgtgtttggctcggggcttcttcccagaccacgtagaactttcctggtgggtcaatggaaaggaggttcattccggagtgtccactgatccccaagcgtacaaggaatccaactatagctactgtctctcatctcggctccgggtgagtgcgacattctggcataatcctcggaaccactttcgatgccaagtgcagtttcatgggttgagcgaggaagacaagtggcccgagggcagtcctaaaccagtcactcaaaacataagcgccgaggcatggggtagagccgattgtgggattactagcgcttcataccaacaaggggtattgagcgctacaattctttacgaaattctcctcggcaaggcgacgctctacgccgtactggtgtctactctcgtggttatggcaatggtgaaacggaaaaacagctaatag

SEQ ID NO: 209 - DNA, 1794 bp, Artificial Sequence
  CT 538: pLenti 1 CEA TCR TRAV8-1*01 L110F TRBV26*01 L117T with regular murine constant region
atgcacagcctcctggggttgttgatggtgtcactgtggctgcaactgacaagggtgaatagtcaactagcagaagagaatccgtgggccctgagcgtccacgagggtgaaagtgtcacggtgaattgtagttacaagacatccataactgccctacagtggtacagacagaagtcaggcgaaggccctgcccagctaatcttaatacgttcaaatgagagagagaagcgcaatggaagactcagagccacccttgacacctccagccagagcagctccttgtccatcactgctactcggtgtgaagacaccgctgtgtacttctgtgctactgatttcacctcaggaggaaactacaaatttgggaaagggaccagcctcgtggttcatccagacattcagaaccccgaaccagccgtatatcagttgaaggacccaagatctcaggatagtacactctgtttgtttacggactttgactcacaaatcaacgtcccgaagactatggaaagtggtacgttcatcacagataagacggttctggacatgaaggctatggactcaaagagcaacggggcaattgcttggtccaaccagacaagctttacctgtcaggacatttttaaggagactaatgctacttatccctccagcgacgttccgtgtgatgcgactcttaccgagaagtcttttgagaccgatatgaatctcaacttccagaatctgtcagtgatgggtctgcggatcctgcttctgaaggttgcaggattcaatcttcttatgactctccggctctggtcttcaggttctggcgcgacgaattttagtttgcttaagcaagccggagatgtggaggaaaatcctggaccgatggctacaaggctcctctgttacacagtactttgtctcctgggtgcaagaattttgaactcaaaagtcattcagactccaagatatctggtgaaagggcaaggacaaaaagcaaagatgaggtgtatccctgaaaagggacatccagttgtattctggtatcaacaaaataagaacaatgagtttaaatttttgattaactttcagaatcaagaagttcttcagcaaatagacatgactgaaaaacgattctctgctgagtgtccttcaaactcaccttgcagcctagaaattcagtcctctgaggcaggagactcagcactgtacctctgtgccagcagtctggggacaggggactatgaacagtacttcggtcccggcaccaggctcacggttttagaggatctccggaacgtcaccccaccaaaggtcagtttgtttgagccatcaaaggcggagatcgccaacaaacagaaagctacgctcgtgtgtttggctcggggcttcttcccagaccacgtagaactttcctggtgggtcaatggaaaggaggttcattccggagtgtccactgatccccaagcgtacaaggaatccaactatagctactgtctctcatctcggctccgggtgagtgcgacattctggcataatcctcggaaccactttcgatgccaagtgcagtttcatgggttgagcgaggaagacaagtggcccgagggcagtcctaaaccagtcactcaaaacataagcgccgaggcatggggtagagccgattgtgggattactagcgcttcataccaacaaggggtattgagcgctacaattctttacgaaattctcctcggcaaggcgacgctctacgccgtactggtgtctactctcgtggttatggcaatggtgaaacggaaaaacagctaatag

SEQ ID NO: 210 - DNA, 1794 bp, Artificial Sequence
  CT 539: pLenti 1 CEA TCR TRAV8-1*01 S112T TRBV26*01 L117T with regular murine constant region
atgcacagcctcctggggttgttgatggtgtcactgtggctgcaactgacaagggtgaatagtcaactagcagaagagaatccgtgggccctgagcgtccacgagggtgaaagtgtcacggtgaattgtagttacaagacatccataactgccctacagtggtacagacagaagtcaggcgaaggccctgcccagctaatcttaatacgttcaaatgagagagagaagcgcaatggaagactcagagccacccttgacacctccagccagagcagctccttgtccatcactgctactcggtgtgaagacaccgctgtgtacttctgtgctactgatctaaccaccggaggaaactacaaatttgggaaagggaccagcctcgtggttcatccagacattcagaaccccgaaccagccgtatatcagttgaaggacccaagatctcaggatagtacactctgtttgtttacggactttgactcacaaatcaacgtcccgaagactatggaaagtggtacgttcatcacagataagacggttctggacatgaaggctatggactcaaagagcaacggggcaattgcttggtccaaccagacaagctttacctgtcaggacatttttaaggagactaatgctacttatccctccagcgacgttccgtgtgatgcgactcttaccgagaagtcttttgagaccgatatgaatctcaacttccagaatctgtcagtgatgggtctgcggatcctgcttctgaaggttgcaggattcaatcttcttatgactctccggctctggtcttcaggttctggcgcgacgaattttagtttgcttaagcaagccggagatgtggaggaaaatcctggaccgatggctacaaggctcctctgttacacagtactttgtctcctgggtgcaagaattttgaactcaaaagtcattcagactccaagatatctggtgaaagggcaaggacaaaaagcaaagatgaggtgtatccctgaaaagggacatccagttgtattctggtatcaacaaaataagaacaatgagtttaaatttttgattaactttcagaatcaagaagttcttcagcaaatagacatgactgaaaaacgattctctgctgagtgtccttcaaactcaccttgcagcctagaaattcagtcctctgaggcaggagactcagcactgtacctctgtgccagcagtctggggacaggggactatgaacagtacttcggtcccggcaccaggctcacggttttagaggatctccggaacgtcaccccaccaaaggtcagtttgtttgagccatcaaaggcggagatcgccaacaaacagaaagctacgctcgtgtgtttggctcggggcttcttcccagaccacgtagaactttcctggtgggtcaatggaaaggaggttcattccggagtgtccactgatccccaagcgtacaaggaatccaactatagctactgtctctcatctcggctccgggtgagtgcgacattctggcataatcctcggaaccactttcgatgccaagtgcagtttcatgggttgagcgaggaagacaagtggcccgagggcagtcctaaaccagtcactcaaaacataagcgccgaggcatggggtagagccgattgtgggattactagcgcttcataccaacaaggggtattgagcgctacaattctttacgaaattctcctcggcaaggcgacgctctacgccgtactggtgtctactctcgtggttatggcaatggtgaaacggaaaaacagctaatag

SEQ ID NO: 211 - DNA, 1794 bp, Artificial Sequence
  CT 540: pLenti 1 CEA TCR TRAV8-1*01 L110F & S112T TRBV26*01 L117T with regular murine constant region
atgcacagcctcctggggttgttgatggtgtcactgtggctgcaactgacaagggtgaatagtcaactagcagaagagaatccgtgggccctgagcgtccacgagggtgaaagtgtcacggtgaattgtagttacaagacatccataactgccctacagtggtacagacagaagtcaggcgaaggccctgcccagctaatcttaatacgttcaaatgagagagagaagcgcaatggaagactcagagccacccttgacacctccagccagagcagctccttgtccatcactgctactcggtgtgaagacaccgctgtgtacttctgtgctactgatttcaccaccggaggaaactacaaatttgggaaagggaccagcctcgtggttcatccagacattcagaaccccgaaccagccgtatatcagttgaaggacccaagatctcaggatagtacactctgtttgtttacggactttgactcacaaatcaacgtcccgaagactatggaaagtggtacgttcatcacagataagacggttctggacatgaaggctatggactcaaagagcaacggggcaattgcttggtccaaccagacaagctttacctgtcaggacatttttaaggagactaatgctacttatccctccagcgacgttccgtgtgatgcgactcttaccgagaagtcttttgagaccgatatgaatctcaacttccagaatctgtcagtgatgggtctgcggatcctgcttctgaaggttgcaggattcaatcttcttatgactctccggctctggtcttcaggttctggcgcgacgaattttagtttgcttaagcaagccggagatgtggaggaaaatcctggaccgatggctacaaggctcctctgttacacagtactttgtctcctgggtgcaagaattttgaactcaaaagtcattcagactccaagatatctggtgaaagggcaaggacaaaaagcaaagatgaggtgtatccctgaaaagggacatccagttgtattctggtatcaacaaaataagaacaatgagtttaaatttttgattaactttcagaatcaagaagttcttcagcaaatagacatgactgaaaaacgattctctgctgagtgtccttcaaactcaccttgcagcctagaaattcagtcctctgaggcaggagactcagcactgtacctctgtgccagcagtctggggacaggggactatgaacagtacttcggtcccggcaccaggctcacggttttagaggatctccggaacgtcaccccaccaaaggtcagtttgtttgagccatcaaaggcggagatcgccaacaaacagaaagctacgctcgtgtgtttggctcggggcttcttcccagaccacgtagaactttcctggtgggtcaatggaaaggaggttcattccggagtgtccactgatccccaagcgtacaaggaatccaactatagctactgtctctcatctcggctccgggtgagtgcgacattctggcataatcctcggaaccactttcgatgccaagtgcagtttcatgggttgagcgaggaagacaagtggcccgagggcagtcctaaaccagtcactcaaaacataagcgccgaggcatggggtagagccgattgtgggattactagcgcttcataccaacaaggggtattgagcgctacaattctttacgaaattctcctcggcaaggcgacgctctacgccgtactggtgtctactctcgtggttatggcaatggtgaaacggaaaaacagctaatag

SEQ ID NO: 212 - DNA, 1794 bp, Artificial Sequence
  CT 541: pLenti 1 CEA TCR TRAV8-1*01 L110F TRBV26*01 with murine constant region
atgcacagcctcctggggttgttgatggtgtcactgtggctgcaactgacaagggtgaatagtcaactagcagaagagaatccgtgggccctgagcgtccacgagggtgaaagtgtcacggtgaattgtagttacaagacatccataactgccctacagtggtacagacagaagtcaggcgaaggccctgcccagctaatcttaatacgttcaaatgagagagagaagcgcaatggaagactcagagccacccttgacacctccagccagagcagctccttgtccatcactgctactcggtgtgaagacaccgctgtgtacttctgtgctactgatttcacctcaggaggaaactacaaatttgggaaagggaccagcctcgtggttcatccaaatattcagaaccccgaaccagccgtatatcagttgaaggacccaagatctcaggatagtacactctgtttgtttacggactttgactcacaaatcaacgtcccgaagactatggaaagtggtacgttcatcacagataagtgcgttctggacatgaaggctatggactcaaagagcaacggggcaattgcttggtccaaccagacaagctttacctgtcaggacatttttaaggagactaatgctacttatccctccagcgacgttccgtgtgatgcgactcttaccgagaagtcttttgagaccgatatgaatctcaacttccagaatctgctggtgatcgttctgcggatcctgcttctgaaggttgcaggattcaatcttcttatgactctccggctctggtcttcaggttctggcgcgacgaattttagtttgcttaagcaagccggagatgtggaggaaaatcctggaccgatggctacaaggctcctctgttacacagtactttgtctcctgggtgcaagaattttgaactcaaaagtcattcagactccaagatatctggtgaaagggcaaggacaaaaagcaaagatgaggtgtatccctgaaaagggacatccagttgtattctggtatcaacaaaataagaacaatgagtttaaatttttgattaactttcagaatcaagaagttcttcagcaaatagacatgactgaaaaacgattctctgctgagtgtccttcaaactcaccttgcagcctagaaattcagtcctctgaggcaggagactcagcactgtacctctgtgccagcagtctgggactgggggactatgaacagtacttcggtcccggcaccaggctcacggttttagaggacctgcgcaacgtcaccccaccaaaggtcagtttgtttgagccatcaaaggcggagatcgccaacaaacagaaagctacgctcgtgtgtttggctcggggcttcttcccagaccacgtagaactttcctggtgggtcaatggaaaggaggttcattccggagtgtgcactgatccccaagcgtacaaggaatccaactatagctactgtctctcatctcggctccgggtgagtgcgacattctggcataatcctcggaaccactttcgatgccaagtgcagtttcatgggttgagcgaggaagacaagtggcccgagggcagtcctaaaccagtcactcaaaacataagcgccgaggcatggggtagagccgattgtgggattactagcgcttcataccaacaaggggtattgagcgctacaattctttacgaaattctcctcggcaaggcgacgctctacgccgtactggtgtctactctcgtggttatggcaatggtgaaacggaaaaacagctaatag

SEQ ID NO: 213 - DNA, 1794 bp, Artificial Sequence
  CT 542:  pLenti 1 CEA TCR TRAV8-1*01 S112T TRBV26*01 with murine constant region
atgcacagcctcctggggttgttgatggtgtcactgtggctgcaactgacaagggtgaatagtcaactagcagaagagaatccgtgggccctgagcgtccacgagggtgaaagtgtcacggtgaattgtagttacaagacatccataactgccctacagtggtacagacagaagtcaggcgaaggccctgcccagctaatcttaatacgttcaaatgagagagagaagcgcaatggaagactcagagccacccttgacacctccagccagagcagctccttgtccatcactgctactcggtgtgaagacaccgctgtgtacttctgtgctactgatctaaccaccggaggaaactacaaatttgggaaagggaccagcctcgtggttcatccaaatattcagaaccccgaaccagccgtatatcagttgaaggacccaagatctcaggatagtacactctgtttgtttacggactttgactcacaaatcaacgtcccgaagactatggaaagtggtacgttcatcacagataagtgcgttctggacatgaaggctatggactcaaagagcaacggggcaattgcttggtccaaccagacaagctttacctgtcaggacatttttaaggagactaatgctacttatccctccagcgacgttccgtgtgatgcgactcttaccgagaagtcttttgagaccgatatgaatctcaacttccagaatctgctggtgatcgttctgcggatcctgcttctgaaggttgcaggattcaatcttcttatgactctccggctctggtcttcaggttctggcgcgacgaattttagtttgcttaagcaagccggagatgtggaggaaaatcctggaccgatggctacaaggctcctctgttacacagtactttgtctcctgggtgcaagaattttgaactcaaaagtcattcagactccaagatatctggtgaaagggcaaggacaaaaagcaaagatgaggtgtatccctgaaaagggacatccagttgtattctggtatcaacaaaataagaacaatgagtttaaatttttgattaactttcagaatcaagaagttcttcagcaaatagacatgactgaaaaacgattctctgctgagtgtccttcaaactcaccttgcagcctagaaattcagtcctctgaggcaggagactcagcactgtacctctgtgccagcagtctgggactgggggactatgaacagtacttcggtcccggcaccaggctcacggttttagaggacctgcgcaacgtcaccccaccaaaggtcagtttgtttgagccatcaaaggcggagatcgccaacaaacagaaagctacgctcgtgtgtttggctcggggcttcttcccagaccacgtagaactttcctggtgggtcaatggaaaggaggttcattccggagtgtgcactgatccccaagcgtacaaggaatccaactatagctactgtctctcatctcggctccgggtgagtgcgacattctggcataatcctcggaaccactttcgatgccaagtgcagtttcatgggttgagcgaggaagacaagtggcccgagggcagtcctaaaccagtcactcaaaacataagcgccgaggcatggggtagagccgattgtgggattactagcgcttcataccaacaaggggtattgagcgctacaattctttacgaaattctcctcggcaaggcgacgctctacgccgtactggtgtctactctcgtggttatggcaatggtgaaacggaaaaacagctaatag

SEQ ID NO: 214 - DNA, 1794 bp, Artificial Sequence
  CT 543: pLenti 1 CEA TCR TRAV8-1*01 L110F & S112T TRBV26*01 with murine constant region
atgcacagcctcctggggttgttgatggtgtcactgtggctgcaactgacaagggtgaatagtcaactagcagaagagaatccgtgggccctgagcgtccacgagggtgaaagtgtcacggtgaattgtagttacaagacatccataactgccctacagtggtacagacagaagtcaggcgaaggccctgcccagctaatcttaatacgttcaaatgagagagagaagcgcaatggaagactcagagccacccttgacacctccagccagagcagctccttgtccatcactgctactcggtgtgaagacaccgctgtgtacttctgtgctactgatttcaccaccggaggaaactacaaatttgggaaagggaccagcctcgtggttcatccaaatattcagaaccccgaaccagccgtatatcagttgaaggacccaagatctcaggatagtacactctgtttgtttacggactttgactcacaaatcaacgtcccgaagactatggaaagtggtacgttcatcacagataagtgcgttctggacatgaaggctatggactcaaagagcaacggggcaattgcttggtccaaccagacaagctttacctgtcaggacatttttaaggagactaatgctacttatccctccagcgacgttccgtgtgatgcgactcttaccgagaagtcttttgagaccgatatgaatctcaacttccagaatctgctggtgatcgttctgcggatcctgcttctgaaggttgcaggattcaatcttcttatgactctccggctctggtcttcaggttctggcgcgacgaattttagtttgcttaagcaagccggagatgtggaggaaaatcctggaccgatggctacaaggctcctctgttacacagtactttgtctcctgggtgcaagaattttgaactcaaaagtcattcagactccaagatatctggtgaaagggcaaggacaaaaagcaaagatgaggtgtatccctgaaaagggacatccagttgtattctggtatcaacaaaataagaacaatgagtttaaatttttgattaactttcagaatcaagaagttcttcagcaaatagacatgactgaaaaacgattctctgctgagtgtccttcaaactcaccttgcagcctagaaattcagtcctctgaggcaggagactcagcactgtacctctgtgccagcagtctgggactgggggactatgaacagtacttcggtcccggcaccaggctcacggttttagaggacctgcgcaacgtcaccccaccaaaggtcagtttgtttgagccatcaaaggcggagatcgccaacaaacagaaagctacgctcgtgtgtttggctcggggcttcttcccagaccacgtagaactttcctggtgggtcaatggaaaggaggttcattccggagtgtgcactgatccccaagcgtacaaggaatccaactatagctactgtctctcatctcggctccgggtgagtgcgacattctggcataatcctcggaaccactttcgatgccaagtgcagtttcatgggttgagcgaggaagacaagtggcccgagggcagtcctaaaccagtcactcaaaacataagcgccgaggcatggggtagagccgattgtgggattactagcgcttcataccaacaaggggtattgagcgctacaattctttacgaaattctcctcggcaaggcgacgctctacgccgtactggtgtctactctcgtggttatggcaatggtgaaacggaaaaacagctaatag

SEQ ID NO: 215 - DNA, 1794 bp, Artificial Sequence
  CT 544: pLenti 1 CEA TCR  TRAV8-1*01 TRBV26*01 L117T with murine constant region
atgcacagcctcctggggttgttgatggtgtcactgtggctgcaactgacaagggtgaatagtcaactagcagaagagaatccgtgggccctgagcgtccacgagggtgaaagtgtcacggtgaattgtagttacaagacatccataactgccctacagtggtacagacagaagtcaggcgaaggccctgcccagctaatcttaatacgttcaaatgagagagagaagcgcaatggaagactcagagccacccttgacacctccagccagagcagctccttgtccatcactgctactcggtgtgaagacaccgctgtgtacttctgtgctactgatctaacctcaggaggaaactacaaatttgggaaagggaccagcctcgtggttcatccaaatattcagaaccccgaaccagccgtatatcagttgaaggacccaagatctcaggatagtacactctgtttgtttacggactttgactcacaaatcaacgtcccgaagactatggaaagtggtacgttcatcacagataagtgcgttctggacatgaaggctatggactcaaagagcaacggggcaattgcttggtccaaccagacaagctttacctgtcaggacatttttaaggagactaatgctacttatccctccagcgacgttccgtgtgatgcgactcttaccgagaagtcttttgagaccgatatgaatctcaacttccagaatctgctggtgatcgttctgcggatcctgcttctgaaggttgcaggattcaatcttcttatgactctccggctctggtcttcaggttctggcgcgacgaattttagtttgcttaagcaagccggagatgtggaggaaaatcctggaccgatggctacaaggctcctctgttacacagtactttgtctcctgggtgcaagaattttgaactcaaaagtcattcagactccaagatatctggtgaaagggcaaggacaaaaagcaaagatgaggtgtatccctgaaaagggacatccagttgtattctggtatcaacaaaataagaacaatgagtttaaatttttgattaactttcagaatcaagaagttcttcagcaaatagacatgactgaaaaacgattctctgctgagtgtccttcaaactcaccttgcagcctagaaattcagtcctctgaggcaggagactcagcactgtacctctgtgccagcagtctggggacaggggactatgaacagtacttcggtcccggcaccaggctcacggttttagaggacctgcgcaacgtcaccccaccaaaggtcagtttgtttgagccatcaaaggcggagatcgccaacaaacagaaagctacgctcgtgtgtttggctcggggcttcttcccagaccacgtagaactttcctggtgggtcaatggaaaggaggttcattccggagtgtgcactgatccccaagcgtacaaggaatccaactatagctactgtctctcatctcggctccgggtgagtgcgacattctggcataatcctcggaaccactttcgatgccaagtgcagtttcatgggttgagcgaggaagacaagtggcccgagggcagtcctaaaccagtcactcaaaacataagcgccgaggcatggggtagagccgattgtgggattactagcgcttcataccaacaaggggtattgagcgctacaattctttacgaaattctcctcggcaaggcgacgctctacgccgtactggtgtctactctcgtggttatggcaatggtgaaacggaaaaacagctaatag

SEQ ID NO: 216 - DNA, 1794 bp, Artificial Sequence
  CT 545: pLenti 1 CEA TCR TRAV8-1*01 L110F TRBV26*01 L117T with murine constant region
atgcacagcctcctggggttgttgatggtgtcactgtggctgcaactgacaagggtgaatagtcaactagcagaagagaatccgtgggccctgagcgtccacgagggtgaaagtgtcacggtgaattgtagttacaagacatccataactgccctacagtggtacagacagaagtcaggcgaaggccctgcccagctaatcttaatacgttcaaatgagagagagaagcgcaatggaagactcagagccacccttgacacctccagccagagcagctccttgtccatcactgctactcggtgtgaagacaccgctgtgtacttctgtgctactgatttcacctcaggaggaaactacaaatttgggaaagggaccagcctcgtggttcatccaaatattcagaaccccgaaccagccgtatatcagttgaaggacccaagatctcaggatagtacactctgtttgtttacggactttgactcacaaatcaacgtcccgaagactatggaaagtggtacgttcatcacagataagtgcgttctggacatgaaggctatggactcaaagagcaacggggcaattgcttggtccaaccagacaagctttacctgtcaggacatttttaaggagactaatgctacttatccctccagcgacgttccgtgtgatgcgactcttaccgagaagtcttttgagaccgatatgaatctcaacttccagaatctgctggtgatcgttctgcggatcctgcttctgaaggttgcaggattcaatcttcttatgactctccggctctggtcttcaggttctggcgcgacgaattttagtttgcttaagcaagccggagatgtggaggaaaatcctggaccgatggctacaaggctcctctgttacacagtactttgtctcctgggtgcaagaattttgaactcaaaagtcattcagactccaagatatctggtgaaagggcaaggacaaaaagcaaagatgaggtgtatccctgaaaagggacatccagttgtattctggtatcaacaaaataagaacaatgagtttaaatttttgattaactttcagaatcaagaagttcttcagcaaatagacatgactgaaaaacgattctctgctgagtgtccttcaaactcaccttgcagcctagaaattcagtcctctgaggcaggagactcagcactgtacctctgtgccagcagtctggggacaggggactatgaacagtacttcggtcccggcaccaggctcacggttttagaggacctgcgcaacgtcaccccaccaaaggtcagtttgtttgagccatcaaaggcggagatcgccaacaaacagaaagctacgctcgtgtgtttggctcggggcttcttcccagaccacgtagaactttcctggtgggtcaatggaaaggaggttcattccggagtgtgcactgatccccaagcgtacaaggaatccaactatagctactgtctctcatctcggctccgggtgagtgcgacattctggcataatcctcggaaccactttcgatgccaagtgcagtttcatgggttgagcgaggaagacaagtggcccgagggcagtcctaaaccagtcactcaaaacataagcgccgaggcatggggtagagccgattgtgggattactagcgcttcataccaacaaggggtattgagcgctacaattctttacgaaattctcctcggcaaggcgacgctctacgccgtactggtgtctactctcgtggttatggcaatggtgaaacggaaaaacagctaatag

SEQ ID NO: 217 - DNA, 1794 bp, Artificial Sequence
  CT 546: pLenti 1 CEA TCR TRAV8-1*01 S112T TRBV26*01 L117T with murine constant region
atgcacagcctcctggggttgttgatggtgtcactgtggctgcaactgacaagggtgaatagtcaactagcagaagagaatccgtgggccctgagcgtccacgagggtgaaagtgtcacggtgaattgtagttacaagacatccataactgccctacagtggtacagacagaagtcaggcgaaggccctgcccagctaatcttaatacgttcaaatgagagagagaagcgcaatggaagactcagagccacccttgacacctccagccagagcagctccttgtccatcactgctactcggtgtgaagacaccgctgtgtacttctgtgctactgatctaaccaccggaggaaactacaaatttgggaaagggaccagcctcgtggttcatccaaatattcagaaccccgaaccagccgtatatcagttgaaggacccaagatctcaggatagtacactctgtttgtttacggactttgactcacaaatcaacgtcccgaagactatggaaagtggtacgttcatcacagataagtgcgttctggacatgaaggctatggactcaaagagcaacggggcaattgcttggtccaaccagacaagctttacctgtcaggacatttttaaggagactaatgctacttatccctccagcgacgttccgtgtgatgcgactcttaccgagaagtcttttgagaccgatatgaatctcaacttccagaatctgctggtgatcgttctgcggatcctgcttctgaaggttgcaggattcaatcttcttatgactctccggctctggtcttcaggttctggcgcgacgaattttagtttgcttaagcaagccggagatgtggaggaaaatcctggaccgatggctacaaggctcctctgttacacagtactttgtctcctgggtgcaagaattttgaactcaaaagtcattcagactccaagatatctggtgaaagggcaaggacaaaaagcaaagatgaggtgtatccctgaaaagggacatccagttgtattctggtatcaacaaaataagaacaatgagtttaaatttttgattaactttcagaatcaagaagttcttcagcaaatagacatgactgaaaaacgattctctgctgagtgtccttcaaactcaccttgcagcctagaaattcagtcctctgaggcaggagactcagcactgtacctctgtgccagcagtctggggacaggggactatgaacagtacttcggtcccggcaccaggctcacggttttagaggacctgcgcaacgtcaccccaccaaaggtcagtttgtttgagccatcaaaggcggagatcgccaacaaacagaaagctacgctcgtgtgtttggctcggggcttcttcccagaccacgtagaactttcctggtgggtcaatggaaaggaggttcattccggagtgtgcactgatccccaagcgtacaaggaatccaactatagctactgtctctcatctcggctccgggtgagtgcgacattctggcataatcctcggaaccactttcgatgccaagtgcagtttcatgggttgagcgaggaagacaagtggcccgagggcagtcctaaaccagtcactcaaaacataagcgccgaggcatggggtagagccgattgtgggattactagcgcttcataccaacaaggggtattgagcgctacaattctttacgaaattctcctcggcaaggcgacgctctacgccgtactggtgtctactctcgtggttatggcaatggtgaaacggaaaaacagctaatag

SEQ ID NO: 218 - DNA, 1794 bp, Artificial Sequence
  CT 547: pLenti 1 CEA TCR TRAV8-1*01 L110F & S112T TRBV26*01 L117T with murine constant region
atgcacagcctcctggggttgttgatggtgtcactgtggctgcaactgacaagggtgaatagtcaactagcagaagagaatccgtgggccctgagcgtccacgagggtgaaagtgtcacggtgaattgtagttacaagacatccataactgccctacagtggtacagacagaagtcaggcgaaggccctgcccagctaatcttaatacgttcaaatgagagagagaagcgcaatggaagactcagagccacccttgacacctccagccagagcagctccttgtccatcactgctactcggtgtgaagacaccgctgtgtacttctgtgctactgatttcaccaccggaggaaactacaaatttgggaaagggaccagcctcgtggttcatccaaatattcagaaccccgaaccagccgtatatcagttgaaggacccaagatctcaggatagtacactctgtttgtttacggactttgactcacaaatcaacgtcccgaagactatggaaagtggtacgttcatcacagataagtgcgttctggacatgaaggctatggactcaaagagcaacggggcaattgcttggtccaaccagacaagctttacctgtcaggacatttttaaggagactaatgctacttatccctccagcgacgttccgtgtgatgcgactcttaccgagaagtcttttgagaccgatatgaatctcaacttccagaatctgctggtgatcgttctgcggatcctgcttctgaaggttgcaggattcaatcttcttatgactctccggctctggtcttcaggttctggcgcgacgaattttagtttgcttaagcaagccggagatgtggaggaaaatcctggaccgatggctacaaggctcctctgttacacagtactttgtctcctgggtgcaagaattttgaactcaaaagtcattcagactccaagatatctggtgaaagggcaaggacaaaaagcaaagatgaggtgtatccctgaaaagggacatccagttgtattctggtatcaacaaaataagaacaatgagtttaaatttttgattaactttcagaatcaagaagttcttcagcaaatagacatgactgaaaaacgattctctgctgagtgtccttcaaactcaccttgcagcctagaaattcagtcctctgaggcaggagactcagcactgtacctctgtgccagcagtctggggacaggggactatgaacagtacttcggtcccggcaccaggctcacggttttagaggacctgcgcaacgtcaccccaccaaaggtcagtttgtttgagccatcaaaggcggagatcgccaacaaacagaaagctacgctcgtgtgtttggctcggggcttcttcccagaccacgtagaactttcctggtgggtcaatggaaaggaggttcattccggagtgtgcactgatccccaagcgtacaaggaatccaactatagctactgtctctcatctcggctccgggtgagtgcgacattctggcataatcctcggaaccactttcgatgccaagtgcagtttcatgggttgagcgaggaagacaagtggcccgagggcagtcctaaaccagtcactcaaaacataagcgccgaggcatggggtagagccgattgtgggattactagcgcttcataccaacaaggggtattgagcgctacaattctttacgaaattctcctcggcaaggcgacgctctacgccgtactggtgtctactctcgtggttatggcaatggtgaaacggaaaaacagctaatag

SEQ ID NO: 219 - DNA, 1608 bp, Artificial Sequence
  CT618: CAR with scFv that target  CEA
atggacatgagggtccccgctcagctcctggggctcctgctactctggctccgaggtgccagatgtcaggtgcagctggtgcaatctgggtctgagttgaagaagcctggggcctcagtgaaggtttcctgcaaggcttctggatacaccttcactgagtttggaatgaactgggtgcgacaggcccctggacaagggcttgagtggatgggatggataaacaccaaaactggagaggcaacatatgttgaagagtttaagggacggtttgtcttctccttggacacctctgtcagcacggcatatctgcagatcagcagcctaaaggctgaagacactgccgtgtattactgtgcgagatgggacttcgcttattacgtggaggctatggactactggggccaagggaccacggtgaccgtgtcatccggcggaggtggaagcggagggggaggatctggcggcggaggaagcggaggcgatatccagatgacccagtctccatcctccctgtctgcatctgtgggagacagagtcaccatcacttgcaaggccagtcagaatgtgggtactaatgttgcctggtatcagcagaaaccagggaaagcacctaagctcctgatctattcggcatcctaccgctacagtggagtcccatcaaggttcagtggcagtggatctgggacagatttcactctcaccatcagcagtctgcaacctgaagatttcgcaacttactactgtcaccaatattacacctatcctctattcacgtttggccagggcaccaagctcgagatcaagacaacgacgccagctccccgcccgccaacccctgcacctacgattgcatcacaaccgctgtccctgcggcctgaagcttgtcgcccagccgcaggtggcgccgtacatacacgggggctggattttgcctgtgatttctgggtgctggtcgttgtgggcggcgtgctggcctgctacagcctgctggtgacagtggccttcatcatcttttgggtgaggagcaagcggagtcgactgctgcacagcgactacatgaacatgaccccccggaggcctggccccacccggaagcactaccagccctacgcccctcccagggatttcgccgcctaccggagcaaacggggcagaaagaaactcctgtatatattcaaacaaccatttatgaggccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagcgtagaggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggactcagtacagccaccaaggacacctacgacgcccttcacatgcaggccctgccccctcgctaa

SEQ ID NO: 220 - DNA, 1614 bp, Artificial Sequence
  CT619: CAR with scFv that target  CEA
atggacatgagggtccccgctcagctcctggggctcctgctactctggctccgaggtgccagatgtcaggtgcagctggtgcagtctggcgccgaagtgaagaaacctggagctagtgtgaaggtgtcctgcaaggccagcggctacaccttcaccgagttcggcatgaactgggtccgacaggctccaggccagggcctcgaatggatgggctggatcaacaccaagaccggcgaggccacctacgtggaagagttcaagggcagagtgaccttcaccacggacaccagcaccagcaccgcctacatggaactgcggagcctgagaagcgacgacaccgccgtgtactactgcgccagatgggacttcgcttattacgtggaagccatggactactggggccagggcaccaccgtgaccgtgtctagcggcggaggtggaagcggagggggaggatctggcggcggaggaagcggaggcgatatccagatgacccagtctccatcctccctgtctgcatctgtgggagacagagtcaccatcacttgcaaggccagtgcggctgtgggtacgtatgttgcgtggtatcagcagaaaccagggaaagcacctaagctcctgatctattcggcatcctaccgcaaaaggggagtcccatcaaggttcagtggcagtggatctgggacagatttcactctcaccatcagcagtctgcaacctgaagatttcgcaacttactactgtcaccaatattacacctatcctctattcacgtttggccagggcaccaagctcgagatcaagcgtacgacaacgacgccagctccccgcccgccaacccctgcacctacgattgcatcacaaccgctgtccctgcggcctgaagcttgtcgcccagccgcaggtggcgccgtacatacacgggggctggattttgcctgtgatttctgggtgctggtcgttgtgggcggcgtgctggcctgctacagcctgctggtgacagtggccttcatcatcttttgggtgaggagcaagcggagtcgactgctgcacagcgactacatgaacatgaccccccggaggcctggccccacccggaagcactaccagccctacgcccctcccagggatttcgccgcctaccggagcaaacggggcagaaagaaactcctgtatatattcaaacaaccatttatgaggccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagcgtagaggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggactcagtacagccaccaaggacacctacgacgcccttcacatgcaggccctgccccctcgctag

SEQ ID NO: 221 - DNA, 1611 bp, Artificial Sequence
  CT620: CAR with scFv that target  CEA
atggacatgagggtccccgctcagctcctggggctcctgctactctggctccgaggtgccagatgtcaggtgcagctggtgcaatctgggtctgagttgaagaagcctggggcctcagtgaaggtttcctgcaaggcttctggatacaccttcactgagtttggaatgaactgggtgcgacaggcccctggacaagggcttgagtggatgggatggataaacaccaaaactggagaggcaacatatgttgaagagtttaagggacggtttgtcttctccttggacacctctgtcagcacggcatatctgcagatcagcagcctaaaggctgaagacactgccgtgtattactgtgcgagatgggactttgctcattactttcagactatggactactggggccaagggaccacggtcaccgtctcctcaggcggaggtggaagcggagggggaggatctggcggcggaggaagcggaggcgatatccagatgacccagtctccatcctccctgtctgcatctgtgggagacagagtcaccatcacttgcaaggccagtgcggctgtgggtacgtatgttgcgtggtatcagcagaaaccagggaaagcacctaagctcctgatctattcggcatcctaccgcaaaaggggagtcccatcaaggttcagtggcagtggatctgggacagatttcactctcaccatcagcagtctgcaacctgaagatttcgcaacttactactgtcaccaatattacacctatcctctattcacgtttggccagggcaccaagctcgagatcaagcgtacaacgacgccagctccccgcccgccaacccctgcacctacgattgcatcacaaccgctgtccctgcggcctgaagcttgtcgcccagccgcaggtggcgccgtacatacacgggggctggattttgcctgtgatttctgggtgctggtcgttgtgggcggcgtgctggcctgctacagcctgctggtgacagtggccttcatcatcttttgggtgaggagcaagcggagtcgactgctgcacagcgactacatgaacatgaccccccggaggcctggccccacccggaagcactaccagccctacgcccctcccagggatttcgccgcctaccggagcaaacggggcagaaagaaactcctgtatatattcaaacaaccatttatgaggccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagcgtagaggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggactcagtacagccaccaaggacacctacgacgcccttcacatgcaggccctgccccctcgctag

SEQ ID NO: 222 - DNA, 729 bp, Artificial Sequence
  scFv that targets CEA
caggtccagctgcagcagtctggggcagagcttgtgaggtcagggacctcagtcaagttgtcctgcacagcttctggcttcaacattaaagactcctatatgcactggttgaggcaggggcctgaacagggcctggagtggattggatggattgatcctgagaatggtgatactgaatatgccccgaagttccagggcaaggccacttttactacagacacatcctccaacacagcctacctgcagctcagcagcctgacatctgaggacactgccgtctattactgtaatgaagggacaccgacagggccatactattttgactactggggtcaaggaaccacagtcaccgtgtcctcaggcggaggtggaagcggagggggaggatctggcggcggaggaagcggaggcgagaacgttctcacccagtctccagcaatcatgtctgcatctccaggggagaaggtcaccataacctgcagtgccagctcaagtgtaagttacatgcactggttccagcagaagccaggcacttctcccaaactctggatttatagcacatccaacctggcttctggagtccctgctcgcttcagtggcagtggatctgggacctcttactctctcacaatcagccgaatggaggctgaagatgctgccacttattactgccagcaaaggagtagttacccgctcacgttcggtgctgggaccaagctggagctgaaa

SEQ ID NO: 223 - DNA, 729 bp, Artificial Sequence
  scFv that targets CEA
caggtccagctggtgcagtctggggcagaggtgaagaaaccaggggcctcagtcaaggtgtcctgcaaagcttctggcttcaacattaaagactcctatatgcactgggtgaggcaggcgcctggacagggcctggagtggatgggatggattgatcctgagaatggtgatactgaatatgccccgaagttccagggcagggtcactatgactacagacacatccacctccacagcctacatggagctcaggagcctgagatctgacgacactgccgtctattactgtaatgaagggacaccgacagggccatactattttgactactggggtcaaggaaccacagtcaccgtgtcctcaggcggaggtggaagcggagggggaggatctggcggcggaggaagcggaggcgagatcgttctcacccagtctccagcaaccttgtctctgtctccaggggagagggccaccctaagctgcagtgccagctcaagtgtaagttacatgcactggtaccagcagaagccaggccttgctcccagactcctgatttatagcacatccaacctggcttctggaatccctgatcgcttcagtggcagtggatctgggaccgatttcactctcacaatcagccgactggagcctgaagatttcgccgtttattactgccagcaaaggagtagttacccgctcacgttcggtcaggggaccaagctggagatcaaa

SEQ ID NO: 224 - DNA, 729 bp, Artificial Sequence
  scFv that targets CEA
gaggtgcagctggcggagtctgggggaggcttggtacagcctggggggtccctgagactctcctgtgcagcctctggattcacctttagcagcgatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtgtattactgtgcaaagtctaatgagtttctttttgactactggggccaaggtaccctggtcaccgtgtcgagtggcggaggtggaagcggagggggaggatctggcggcggaggaagcggaggctcttctgagctgactcaggaccctgctgtgtctgtggccttgggacagacagtcaggatcacatgccaaggagacagcctcagaagctcttatgcaagctggtaccggcagaggccaggacaggcccctgtacttgtcatctatggtaaaaacaaccggccctcagggatcccagaccgattctctggctccagctcaggaaacacagcttccttgaccatcactggggctcaggcggaagatgaggctgactattactggaactccagctacgcttggctgccctacgtggtattcggcggagggaccaagctgaccgtcctaggt

SEQ ID NO: 225 - DNA, 729 bp, Artificial Sequence
  scFv that targets CEA
caggtccagctggagcagtctggggcaggggttgtgaagccaggggcctcagtcaagttgtcctgcaaagcttctggcttcaacattaaagactcctatatgcactggttgaggcaggggcctggacagcgcctggagtggattggatggattgatcctgagaatggtgatactgaatatgccccgaagttccagggcaaggccacttttactacagacacatccgccaacacagcctacctggggctcagcagcctgagacctgaggacactgccgtctattactgtaatgaagggacaccgacagggccatactattttgactactggggtcaaggaaccctagtcaccgtgtcctcaggcggaggtggaagcggagggggaggatctggcggcggaggaagcggaggcgagaacgttctcacccagtctccaagctctatgtctgtatctgtcggggacagggtcaacatcgcctgcagtgccagctcaagtgtaccttacatgcactggctccagcagaagccaggcaaatctcccaaactcctgatttatctcacatccaacctggcttctggagtccctagccgcttcagtggcagtggatctgggaccgattactctctcacaatcagctcagtgcagcctgaagatgctgccacttattactgccagcaaaggagtagttacccgctcacgttcggtggtgggaccaagctggagatcaaa

SEQ ID NO: 226 - DNA, 738 bp, Artificial Sequence
  scFv that targets CEA
caggtgcagctggtgcaatctgggtctgagttgaagaagcctggggcctcagtgaaggtttcctgcaaggcttctggatacaccttcactgagtttggaatgaactgggtgcgacaggcccctggacaagggcttgagtggatgggatggataaacaccaaaactggagaggcaacatatgttgaagagtttaagggacggtttgtcttctccttggacacctctgtcagcacggcatatctgcagatcagcagcctaaaggctgaagacactgccgtgtattactgtgcgagatgggacttcgcttattacgtggaggctatggactactggggccaagggaccacggtgaccgtgtcatccggcggaggtggaagcggagggggaggatctggcggcggaggaagcggaggcgatatccagatgacccagtctccatcctccctgtctgcatctgtgggagacagagtcaccatcacttgcaaggccagtcagaatgtgggtactaatgttgcctggtatcagcagaaaccagggaaagcacctaagctcctgatctattcggcatcctaccgctacagtggagtcccatcaaggttcagtggcagtggatctgggacagatttcactctcaccatcagcagtctgcaacctgaagatttcgcaacttactactgtcaccaatattacacctatcctctattcacgtttggccagggcaccaagctcgagatcaag

SEQ ID NO: 227 - DNA, 738 bp, Artificial Sequence
  scFv that targets CEA
caggtgcagctggtgcagtctggcgccgaagtgaagaaacctggagctagtgtgaaggtgtcctgcaaggccagcggctacaccttcaccgagttcggcatgaactgggtccgacaggctccaggccagggcctcgaatggatgggctggatcaacaccaagaccggcgaggccacctacgtggaagagttcaagggcagagtgaccttcaccacggacaccagcaccagcaccgcctacatggaactgcggagcctgagaagcgacgacaccgccgtgtactactgcgccagatgggacttcgcttattacgtggaagccatggactactggggccagggcaccaccgtgaccgtgtctagcggcggaggtggaagcggagggggaggatctggcggcggaggaagcggaggcgatatccagatgacccagtctccatcctccctgtctgcatctgtgggagacagagtcaccatcacttgcaaggccagtgcggctgtgggtacgtatgttgcgtggtatcagcagaaaccagggaaagcacctaagctcctgatctattcggcatcctaccgcaaaaggggagtcccatcaaggttcagtggcagtggatctgggacagatttcactctcaccatcagcagtctgcaacctgaagatttcgcaacttactactgtcaccaatattacacctatcctctattcacgtttggccagggcaccaagctcgagatcaag

SEQ ID NO: 228 - DNA, 738 bp, Artificial Sequence
  scFv that targets CEA
caggtgcagctggtgcaatctgggtctgagttgaagaagcctggggcctcagtgaaggtttcctgcaaggcttctggatacaccttcactgagtttggaatgaactgggtgcgacaggcccctggacaagggcttgagtggatgggatggataaacaccaaaactggagaggcaacatatgttgaagagtttaagggacggtttgtcttctccttggacacctctgtcagcacggcatatctgcagatcagcagcctaaaggctgaagacactgccgtgtattactgtgcgagatgggactttgctcattactttcagactatggactactggggccaagggaccacggtcaccgtctcctcaggcggaggtggaagcggagggggaggatctggcggcggaggaagcggaggcgatatccagatgacccagtctccatcctccctgtctgcatctgtgggagacagagtcaccatcacttgcaaggccagtgcggctgtgggtacgtatgttgcgtggtatcagcagaaaccagggaaagcacctaagctcctgatctattcggcatcctaccgcaaaaggggagtcccatcaaggttcagtggcagtggatctgggacagatttcactctcaccatcagcagtctgcaacctgaagatttcgcaacttactactgtcaccaatattacacctatcctctattcacgtttggccagggcaccaagctcgagatcaag

SEQ ID NO: 229 - protein, 616 aa, Artificial Sequence
  H141/A192V allele of TNFRSF11A
MAPRARRRRPLFALLLLCALLARLQVALQIAPPCTSEKHYEHLGRCCNKCEPGKYMSSKCTTTSDSVCLPCGPDEYLDSWNEEDKCLLHKVCDTGKALVAVVAGNSTTPRRCACTAGYHWSQDCECCRRNTECAPGLGAQHPLQLNKDTVCKPCLAGYFSDAFSSTDKCRPWTNCTFLGKRVEHHGTEKSDVVCSSSLPARKPPNEPHVYLPGLIILLLFASVALVAAIIFGVCYRKKGKALTANLWHWINEACGRLSGDKESSGDSCVSTHTANFGQQGACEGVLLLTLEEKTFPEDMCYPDQGGVCQGTCVGGGPYAQGEDARMLSLVSKTEIEEDSFRQMPTEDEYMDRPSQPTDQLLFLTEPGSKSTPPFSEPLEVGENDSLSQCFTGTQSTVGSESCNCTEPLCRTDWTPMSSENYLQKEVDSGHCPHWAASPSPNWADVCTGCRNPPGEDCEPLVGSPKRGPLPQCAYGMGLPPEEEASRTEARDQPEDGADGRLPSSARAGAGSGSSPGGQSPASGNVTGNSNSTFISSGQVMNFKGDIIVVYVSQTSQEGAAAAAEPMGRPVQEETLARRDSFAGNGPRFPDPCGGPEGLREPEKASRPVQEQGGAKA

SEQ ID NO: 230 - protein, 616 aa, Artificial Sequence
  H141Y/A192 allele of TNFRSF11A
MAPRARRRRPLFALLLLCALLARLQVALQIAPPCTSEKHYEHLGRCCNKCEPGKYMSSKCTTTSDSVCLPCGPDEYLDSWNEEDKCLLHKVCDTGKALVAVVAGNSTTPRRCACTAGYHWSQDCECCRRNTECAPGLGAQYPLQLNKDTVCKPCLAGYFSDAFSSTDKCRPWTNCTFLGKRVEHHGTEKSDAVCSSSLPARKPPNEPHVYLPGLIILLLFASVALVAAIIFGVCYRKKGKALTANLWHWINEACGRLSGDKESSGDSCVSTHTANFGQQGACEGVLLLTLEEKTFPEDMCYPDQGGVCQGTCVGGGPYAQGEDARMLSLVSKTEIEEDSFRQMPTEDEYMDRPSQPTDQLLFLTEPGSKSTPPFSEPLEVGENDSLSQCFTGTQSTVGSESCNCTEPLCRTDWTPMSSENYLQKEVDSGHCPHWAASPSPNWADVCTGCRNPPGEDCEPLVGSPKRGPLPQCAYGMGLPPEEEASRTEARDQPEDGADGRLPSSARAGAGSGSSPGGQSPASGNVTGNSNSTFISSGQVMNFKGDIIVVYVSQTSQEGAAAAAEPMGRPVQEETLARRDSFAGNGPRFPDPCGGPEGLREPEKASRPVQEQGGAKA

SEQ ID NO: 231 - protein, 616 aa, Artificial Sequence
  H141Y/A192V allele of TNFRSF11A
MAPRARRRRPLFALLLLCALLARLQVALQIAPPCTSEKHYEHLGRCCNKCEPGKYMSSKCTTTSDSVCLPCGPDEYLDSWNEEDKCLLHKVCDTGKALVAVVAGNSTTPRRCACTAGYHWSQDCECCRRNTECAPGLGAQYPLQLNKDTVCKPCLAGYFSDAFSSTDKCRPWTNCTFLGKRVEHHGTEKSDVVCSSSLPARKPPNEPHVYLPGLIILLLFASVALVAAIIFGVCYRKKGKALTANLWHWINEACGRLSGDKESSGDSCVSTHTANFGQQGACEGVLLLTLEEKTFPEDMCYPDQGGVCQGTCVGGGPYAQGEDARMLSLVSKTEIEEDSFRQMPTEDEYMDRPSQPTDQLLFLTEPGSKSTPPFSEPLEVGENDSLSQCFTGTQSTVGSESCNCTEPLCRTDWTPMSSENYLQKEVDSGHCPHWAASPSPNWADVCTGCRNPPGEDCEPLVGSPKRGPLPQCAYGMGLPPEEEASRTEARDQPEDGADGRLPSSARAGAGSGSSPGGQSPASGNVTGNSNSTFISSGQVMNFKGDIIVVYVSQTSQEGAAAAAEPMGRPVQEETLARRDSFAGNGPRFPDPCGGPEGLREPEKASRPVQEQGGAKA

SEQ ID NO: 232 - protein, 1179 aa, Artificial Sequence
  R950W/V1019 allele of ITGAE
MWLFHTLLCIASLALLAAFNVDVARPWLTPKGGAPFVLSSLLHQDPSTNQTWLLVTSPRTKRTPGPLHRCSLVQDEILCHPVEHVPIPKGRHRGVTVVRSHHGVLICIQVLVRRPHSLSSELTGTCSLLGPDLRPQAQANFFDLENLLDPDARVDTGDCYSNKEGGGEDDVNTARQRRALEKEEEEDKEEEEDEEEEEAGTEIAIILDGSGSIDPPDFQRAKDFISNMMRNFYEKCFECNFALVQYGGVIQTEFDLRDSQDVMASLARVQNITQVGSVTKTASAMQHVLDSIFTSSHGSRRKASKVMVVLTDGGIFEDPLNLTTVINSPKMQGVERFAIGVGEEFKSARTARELNLIASDPDETHAFKVTNYMALDGLLSKLRYNIISMEGTVGDALHYQLAQIGFSAQILDERQVLLGAVGAFDWSGGALLYDTRSRRGRFLNQTAAAAADAEAAQYSYLGYAVAVLHKTCSLSYIAGAPRYKHHGAVFELQKEGREASFLPVLEGEQMGSYFGSELCPVDIDMDGSTDFLLVAAPFYHVHGEEGRVYVYRLSEQDGSFSLARILSGHPGFTNARFGFAMAAMGDLSQDKLTDVAIGAPLEGFGADDGASFGSVYIYNGHWDGLSASPSQRIRASTVAPGLQYFGMSMAGGFDISGDGLADITVGTLGQAVVFRSRPVVRLKVSMAFTPSALPIGFNGVVNVRLCFEISSVTTASESGLREALLNFTLDVDVGKQRRRLQCSDVRSCLGCLREWSSGSQLCEDLLLMPTEGELCEEDCFSNASVKVSYQLQTPEGQTDHPQPILDRYTEPFAIFQLPYEKACKNKLFCVAELQLATTVSQQELVVGLTKELTLNINLTNSGEDSYMTSMALNYPRNLQLKRMQKPPSPNIQCDDPQPVASVLIMNCRIGHPVLKRSSAHVSVVWQLEENAFPNRTADITVTVTNSNERWSLANETHTLQFRHGFVAVLSKPSIMYVNTGQGLSHHKEFLFHVHGENLFGAEYQLQICVPTKLRGLQVVAVKKLTRTQASTVCTWSQERACAYSSVQHVEEWHSVSCVIASDKENVTVAAEISWDHSEELLKDVTELQILGEISFNKSLYEGLNAENHRTKITVVFLKDEKYHSLPIIIKGSVGGLLVLIVILVILFKCGFFKRKYQQLNLESIRKAQLKSENLLEEEN

SEQ ID NO: 233 - protein, 1179 aa, Artificial Sequence
  R950/V1019A allele of ITGAE
MWLFHTLLCIASLALLAAFNVDVARPWLTPKGGAPFVLSSLLHQDPSTNQTWLLVTSPRTKRTPGPLHRCSLVQDEILCHPVEHVPIPKGRHRGVTVVRSHHGVLICIQVLVRRPHSLSSELTGTCSLLGPDLRPQAQANFFDLENLLDPDARVDTGDCYSNKEGGGEDDVNTARQRRALEKEEEEDKEEEEDEEEEEAGTEIAIILDGSGSIDPPDFQRAKDFISNMMRNFYEKCFECNFALVQYGGVIQTEFDLRDSQDVMASLARVQNITQVGSVTKTASAMQHVLDSIFTSSHGSRRKASKVMVVLTDGGIFEDPLNLTTVINSPKMQGVERFAIGVGEEFKSARTARELNLIASDPDETHAFKVTNYMALDGLLSKLRYNIISMEGTVGDALHYQLAQIGFSAQILDERQVLLGAVGAFDWSGGALLYDTRSRRGRFLNQTAAAAADAEAAQYSYLGYAVAVLHKTCSLSYIAGAPRYKHHGAVFELQKEGREASFLPVLEGEQMGSYFGSELCPVDIDMDGSTDFLLVAAPFYHVHGEEGRVYVYRLSEQDGSFSLARILSGHPGFTNARFGFAMAAMGDLSQDKLTDVAIGAPLEGFGADDGASFGSVYIYNGHWDGLSASPSQRIRASTVAPGLQYFGMSMAGGFDISGDGLADITVGTLGQAVVFRSRPVVRLKVSMAFTPSALPIGFNGVVNVRLCFEISSVTTASESGLREALLNFTLDVDVGKQRRRLQCSDVRSCLGCLREWSSGSQLCEDLLLMPTEGELCEEDCFSNASVKVSYQLQTPEGQTDHPQPILDRYTEPFAIFQLPYEKACKNKLFCVAELQLATTVSQQELVVGLTKELTLNINLTNSGEDSYMTSMALNYPRNLQLKRMQKPPSPNIQCDDPQPVASVLIMNCRIGHPVLKRSSAHVSVVWQLEENAFPNRTADITVTVTNSNERRSLANETHTLQFRHGFVAVLSKPSIMYVNTGQGLSHHKEFLFHVHGENLFGAEYQLQICVPTKLRGLQVAAVKKLTRTQASTVCTWSQERACAYSSVQHVEEWHSVSCVIASDKENVTVAAEISWDHSEELLKDVTELQILGEISFNKSLYEGLNAENHRTKITVVFLKDEKYHSLPIIIKGSVGGLLVLIVILVILFKCGFFKRKYQQLNLESIRKAQLKSENLLEEEN

SEQ ID NO: 234 - protein, 1179 aa, Artificial Sequence
  R950/V1019G allele of ITGAE
MWLFHTLLCIASLALLAAFNVDVARPWLTPKGGAPFVLSSLLHQDPSTNQTWLLVTSPRTKRTPGPLHRCSLVQDEILCHPVEHVPIPKGRHRGVTVVRSHHGVLICIQVLVRRPHSLSSELTGTCSLLGPDLRPQAQANFFDLENLLDPDARVDTGDCYSNKEGGGEDDVNTARQRRALEKEEEEDKEEEEDEEEEEAGTEIAIILDGSGSIDPPDFQRAKDFISNMMRNFYEKCFECNFALVQYGGVIQTEFDLRDSQDVMASLARVQNITQVGSVTKTASAMQHVLDSIFTSSHGSRRKASKVMVVLTDGGIFEDPLNLTTVINSPKMQGVERFAIGVGEEFKSARTARELNLIASDPDETHAFKVTNYMALDGLLSKLRYNIISMEGTVGDALHYQLAQIGFSAQILDERQVLLGAVGAFDWSGGALLYDTRSRRGRFLNQTAAAAADAEAAQYSYLGYAVAVLHKTCSLSYIAGAPRYKHHGAVFELQKEGREASFLPVLEGEQMGSYFGSELCPVDIDMDGSTDFLLVAAPFYHVHGEEGRVYVYRLSEQDGSFSLARILSGHPGFTNARFGFAMAAMGDLSQDKLTDVAIGAPLEGFGADDGASFGSVYIYNGHWDGLSASPSQRIRASTVAPGLQYFGMSMAGGFDISGDGLADITVGTLGQAVVFRSRPVVRLKVSMAFTPSALPIGFNGVVNVRLCFEISSVTTASESGLREALLNFTLDVDVGKQRRRLQCSDVRSCLGCLREWSSGSQLCEDLLLMPTEGELCEEDCFSNASVKVSYQLQTPEGQTDHPQPILDRYTEPFAIFQLPYEKACKNKLFCVAELQLATTVSQQELVVGLTKELTLNINLTNSGEDSYMTSMALNYPRNLQLKRMQKPPSPNIQCDDPQPVASVLIMNCRIGHPVLKRSSAHVSVVWQLEENAFPNRTADITVTVTNSNERRSLANETHTLQFRHGFVAVLSKPSIMYVNTGQGLSHHKEFLFHVHGENLFGAEYQLQICVPTKLRGLQVGAVKKLTRTQASTVCTWSQERACAYSSVQHVEEWHSVSCVIASDKENVTVAAEISWDHSEELLKDVTELQILGEISFNKSLYEGLNAENHRTKITVVFLKDEKYHSLPIIIKGSVGGLLVLIVILVILFKCGFFKRKYQQLNLESIRKAQLKSENLLEEEN

SEQ ID NO: 235 - protein, 1179 aa, Artificial Sequence; identical to SEQ ID NO: 232
  R950W/V1019 allele of ITGAE

SEQ ID NO: 236 - protein, 1179 aa, Artificial Sequence
  R950W/V1019A allele of ITGAE
MWLFHTLLCIASLALLAAFNVDVARPWLTPKGGAPFVLSSLLHQDPSTNQTWLLVTSPRTKRTPGPLHRCSLVQDEILCHPVEHVPIPKGRHRGVTVVRSHHGVLICIQVLVRRPHSLSSELTGTCSLLGPDLRPQAQANFFDLENLLDPDARVDTGDCYSNKEGGGEDDVNTARQRRALEKEEEEDKEEEEDEEEEEAGTEIAIILDGSGSIDPPDFQRAKDFISNMMRNFYEKCFECNFALVQYGGVIQTEFDLRDSQDVMASLARVQNITQVGSVTKTASAMQHVLDSIFTSSHGSRRKASKVMVVLTDGGIFEDPLNLTTVINSPKMQGVERFAIGVGEEFKSARTARELNLIASDPDETHAFKVTNYMALDGLLSKLRYNIISMEGTVGDALHYQLAQIGFSAQILDERQVLLGAVGAFDWSGGALLYDTRSRRGRFLNQTAAAAADAEAAQYSYLGYAVAVLHKTCSLSYIAGAPRYKHHGAVFELQKEGREASFLPVLEGEQMGSYFGSELCPVDIDMDGSTDFLLVAAPFYHVHGEEGRVYVYRLSEQDGSFSLARILSGHPGFTNARFGFAMAAMGDLSQDKLTDVAIGAPLEGFGADDGASFGSVYIYNGHWDGLSASPSQRIRASTVAPGLQYFGMSMAGGFDISGDGLADITVGTLGQAVVFRSRPVVRLKVSMAFTPSALPIGFNGVVNVRLCFEISSVTTASESGLREALLNFTLDVDVGKQRRRLQCSDVRSCLGCLREWSSGSQLCEDLLLMPTEGELCEEDCFSNASVKVSYQLQTPEGQTDHPQPILDRYTEPFAIFQLPYEKACKNKLFCVAELQLATTVSQQELVVGLTKELTLNINLTNSGEDSYMTSMALNYPRNLQLKRMQKPPSPNIQCDDPQPVASVLIMNCRIGHPVLKRSSAHVSVVWQLEENAFPNRTADITVTVTNSNERWSLANETHTLQFRHGFVAVLSKPSIMYVNTGQGLSHHKEFLFHVHGENLFGAEYQLQICVPTKLRGLQVAAVKKLTRTQASTVCTWSQERACAYSSVQHVEEWHSVSCVIASDKENVTVAAEISWDHSEELLKDVTELQILGEISFNKSLYEGLNAENHRTKITVVFLKDEKYHSLPIIIKGSVGGLLVLIVILVILFKCGFFKRKYQQLNLESIRKAQLKSENLLEEEN

SEQ ID NO: 237 - protein, 1179 aa, Artificial Sequence
  R950W/V1019G allele of ITGAE
MWLFHTLLCIASLALLAAFNVDVARPWLTPKGGAPFVLSSLLHQDPSTNQTWLLVTSPRTKRTPGPLHRCSLVQDEILCHPVEHVPIPKGRHRGVTVVRSHHGVLICIQVLVRRPHSLSSELTGTCSLLGPDLRPQAQANFFDLENLLDPDARVDTGDCYSNKEGGGEDDVNTARQRRALEKEEEEDKEEEEDEEEEEAGTEIAIILDGSGSIDPPDFQRAKDFISNMMRNFYEKCFECNFALVQYGGVIQTEFDLRDSQDVMASLARVQNITQVGSVTKTASAMQHVLDSIFTSSHGSRRKASKVMVVLTDGGIFEDPLNLTTVINSPKMQGVERFAIGVGEEFKSARTARELNLIASDPDETHAFKVTNYMALDGLLSKLRYNIISMEGTVGDALHYQLAQIGFSAQILDERQVLLGAVGAFDWSGGALLYDTRSRRGRFLNQTAAAAADAEAAQYSYLGYAVAVLHKTCSLSYIAGAPRYKHHGAVFELQKEGREASFLPVLEGEQMGSYFGSELCPVDIDMDGSTDFLLVAAPFYHVHGEEGRVYVYRLSEQDGSFSLARILSGHPGFTNARFGFAMAAMGDLSQDKLTDVAIGAPLEGFGADDGASFGSVYIYNGHWDGLSASPSQRIRASTVAPGLQYFGMSMAGGFDISGDGLADITVGTLGQAVVFRSRPVVRLKVSMAFTPSALPIGFNGVVNVRLCFEISSVTTASESGLREALLNFTLDVDVGKQRRRLQCSDVRSCLGCLREWSSGSQLCEDLLLMPTEGELCEEDCFSNASVKVSYQLQTPEGQTDHPQPILDRYTEPFAIFQLPYEKACKNKLFCVAELQLATTVSQQELVVGLTKELTLNINLTNSGEDSYMTSMALNYPRNLQLKRMQKPPSPNIQCDDPQPVASVLIMNCRIGHPVLKRSSAHVSVVWQLEENAFPNRTADITVTVTNSNERWSLANETHTLQFRHGFVAVLSKPSIMYVNTGQGLSHHKEFLFHVHGENLFGAEYQLQICVPTKLRGLQVGAVKKLTRTQASTVCTWSQERACAYSSVQHVEEWHSVSCVIASDKENVTVAAEISWDHSEELLKDVTELQILGEISFNKSLYEGLNAENHRTKITVVFLKDEKYHSLPIIIKGSVGGLLVLIVILVILFKCGFFKRKYQQLNLESIRKAQLKSENLLEEEN

SEQ ID NO: 238 - DNA, 741 bp, Mus musculus
gatgttctgatgacccaaactccactctccctgcctgtcagtcttggagatcaagcctccatctcttgcagatctagtcagagcattgtacatagtaatggaaacacctatttagaatggtacctgcagaagccaggccagtctccaaagctgctcatctacaaagtttccaaccgattttctggggtcccagacagatttagcggatctggctctgggaccgatttcacactcaagatcagtagagtggaggctgaggatctgggagtttattactgctttcaaggttcacatgttcctcggacgtccggtggaggcacaaagctggaaatcaagggaggtggcggctctggaggcggaggtagcggaggtggaggctctggtggccaggtccagctgcagcagtctggacctgagctggtgaagccaggggcttcagtgaggatatcctgtaaggcctctggctacacctttacaagttaccatatacattgggtgaagcagaggcctggacagggactcgaatggattggatggatttatcctggaaatgttaatactgagtacaatgagaagttcaagggcaaggccacactgactgcagacaaatcgtccagcacagcctacatgcacctcagcagcctgacctctgaggactctgcggtctatttctgtgccagagaggagattacctatgctatggattattggggtcaaggaacctcagtcaccgtgtcctca

SEQ ID NO: 239 - DNA, 741 bp, Artificial Sequence
  humanized HLA-A*02 antigen binding domain
caggtgcagctggtgcagtctggggctgaggtgaagaagcctgggtcctcagtgaaggtttcctgcaaggcttctggatacaccttcactagctatcatatacattgggtgcgccaggcccccggacaagggcttgagtggatgggatggatctaccctggcaatgttaacacagaatataatgagaagttcaagggcaaagccaccattaccgcggacaaatccacgagcacagcctacatggagctgagcagcctgagatctgaagacacggctgtgtattactgtgcgagggaggaaattacctacgctatggactactggggccagggaaccacagtcaccgtgtcctcaggcggaggtggaagcggagggggaggatctggcggcggaggaagcggaggcgagattgtattgacccagagcccaggcaccctgagcctctctccaggagagcgggccaccctcagttgtagatccagtcagagtattgtacacagtaatgggaacacctatttggaatggtatcagcagaaaccaggtcaagccccaagattgctcatctacaaagtctctaacagatttagtggtattccagacaggttcagcggttccggaagtggtactgatttcaccctcacgatctccaggctcgagccagaagatttcgccgtttattactgttttcaaggttcacatgtgccgcgcacattcggtgggggtactaaagtagaaatcaaa

SEQ ID NO: 240 - DNA, 741 bp, Artificial Sequence
  humanized HLA-A*02 antigen binding domain
caggtgcagctggtgcagtctggggctgaggtgaagaagcctgggtcctcagtgaaggtttcctgcaaggcttctggatacaccttcactagctatcatatacattgggtgcgccaggcccccggacaagggcttgagtggatgggatggatctaccctggcaatgttaacacagaatataatgagaagttcaagggcaaagccaccattaccgcggacaaatccacgagcacagcctacatggagctgagcagcctgagatctgaagacacggctgtgtattactgtgcgagggaggaaattacctacgctatggactactggggccagggaaccacagtcaccgtgtcctcaggcggaggtggaagcggagggggaggatctggcggcggaggaagcggaggcgacattgtaatgacccagaccccactcagcctgcccgtcactccaggagagccggccagcatcagttgtagatccagtcagagtattgtacacagtaatgggaacacctatttggaatggtatctgcagaaaccaggtcaatccccacaattgctcatctacaaagtctctaacagatttagtggtgtaccagacaggttcagcggttccggaagtggtactgatttcaccctcaagatctccagggtcgaggcagaagatgtcggcgtttattactgttttcaaggttcacatgtgccgcgcacattcggtgggggtactaaagtagaaatcaaa

SEQ ID NO: 241 - DNA, 741 bp, Artificial Sequence
  humanized HLA-A*02 antigen binding domain
gaggtgcagctggtggagtctgggggtgggctggtgaagcctgggggctcactgaggctttcctgcgcggcttctggatacaccttcactagctatcatatacattgggtgcgccaggcccccggaaaagggcttgagtgggtgggatggatctaccctggcaatgttaacacagaatataatgagaagttcaagggcagattcaccattagcagggacgattccaagaacacactctacctgcagatgaacagcctgaaaactgaagacacggctgtgtattactgtgcgagggaggaaattacctacgctatggactactggggccagggaaccacagtcaccgtgtcctcaggcggaggtggaagcggagggggaggatctggcggcggaggaagcggaggcgacattcaaatgacccagagcccatccagcctgagcgcatctgtaggtgaccgggtcaccatcacttgtagatccagtcagagtattgtacacagtaatgggaacacctatttggaatggtatcagcagaaaccaggtaaagccccaaaattgctcatctacaaagtctctaacagatttagtggtgtaccaagcaggttcagcggttccggaagtggtactgatttcaccctcacgatctcctctctccagccagaagatttcgccacttattactgttttcaaggttcacatgtgccgcgcacattcggtgggggtactaaagtagaaatcaaa

SEQ ID NO: 242 - DNA, 741 bp, Artificial Sequence
  humanized HLA-A*02 antigen binding domain
caggtgcagctggtgcagtctggggctgaggtgaagaagcctgggtcctcagtgaaggtttcctgcaaggcttctggatacaccttcactagctatcatatacattgggtgcgccaggcccccggacaagggcttgagtggatcggatggatctaccctggcaatgttaacacagaatataatgagaagttcaagggcaaagccaccattaccgcggacgaatccacgaacacagcctacatggagctgagcagcctgagatctgaagacacggctgtgtattactgtgcgagggaggaaattacctacgctatggactactggggccagggaaccctggtcaccgtgtcctcaggcggaggtggaagcggagggggaggatctggcggcggaggaagcggaggcgacattcaaatgacccagagcccatccaccctgagcgcatctgtaggtgaccgggtcaccatcacttgtagatccagtcagagtattgtacacagtaatgggaacacctatttggaatggtatcagcagaaaccaggtaaagccccaaaattgctcatctacaaagtctctaacagatttagtggtgtaccagccaggttcagcggttccggaagtggtactgaattcaccctcacgatctcctctctccagccagatgatttcgccacttattactgttttcaaggttcacatgtgccgcgcacattcggtcagggtactaaagtagaagtcaaa

SEQ ID NO: 243 - DNA, 741 bp, Artificial Sequence
  humanized HLA-A*02 antigen binding domain
caggtgcagctggtgcagtctggggctgaggtgaagaagcctgggtcctcagtgaaggtttcctgcaaggcttctggatacaccttcactagctatcatatgcattgggtgcgccaggcccccggacaagggcttgagtggatcggatacatctaccctggcaatgttaacacagaatataatgagaagttcaagggcaaagccacccttaccgcggacaaatccacgaacacagcctacatggagctgagcagcctgagatctgaagacacggctgtgtatttctgtgcgagggaggaaattacctacgctatggactactggggccagggaaccctggtcaccgtgtcctcaggcggaggtggaagcggagggggaggatctggcggcggaggaagcggaggcgacgttcaaatgacccagagcccatccaccctgagcgcatctgtaggtgaccgggtcaccatcacttgtagctccagtcagagtattgtacacagtaatgggaacacctatatggaatggtatcagcagaaaccaggtaaagccccaaaattgctcatctacaaagtctctaacagatttagtggtgtaccagacaggttcagcggttccggaagtggtactgaattcaccctcacgatctcctctctccagccagatgatttcgccacttattactgtcatcaaggttcacatgtgccgcgcacattcggtcagggtactaaagtagaagtcaaa

SEQ ID NO: 244 - DNA, 741 bp, Mus musculus
caggtgcagctgcagcagtctgggcctgagctggtgaagcctggggcctcagtgaagatgtcctgcaaggcttctggatacaccttcactagctatcatatccagtgggtgaagcagaggcctggacaagggcttgagtggatcggatggatctaccctggcgatggtagtacacagtataatgagaagttcaagggcaaaaccacccttaccgcggacaaatcctccagcacagcctacatgttgctgagcagcctgacctctgaagactctgctatctatttctgtgcgagggaggggacctactacgctatggactactggggccagggaacctcagtcaccgtgtcctcaggcggaggtggaagcggagggggaggatctggcggcggaggaagcggaggcgatgttttgatgacccagactccactctccctgcctgtctctcttggagaccaagtctccatctcttgtagatccagtcagagtattgtacacagtaatgggaacacctatttagaatggtatctgcagaaaccaggtcagtctccaaagttgctcatctacaaagtctctaacagatttagtggtgtaccagacaggttcagcggttccggaagtggtactgatttcaccctcaagatctcgagagtggaggctgaggatctgggagtttattactgttttcaaggttcacatgtgccgcgcacattcggtggaggtactaaactggaaatcaaa

SEQ ID NO: 245 - DNA, 741 bp, Artificial Sequence
  humanized HLA-A*02 antigen binding domain
cagctgcagctgcaggagtctgggcccgggctggtgaagccttcggaaacgctgagcctcacctgcacggtttctggatacaccttcaccagctatcatatccagtggatccgacagccccctggaaaagggcttgagtggatcggatggatctaccctggcgatggttcaacacagtacaatgagaagttcaagggcagagccacgattagcgtggacacatccaagaaccaattctccctgaacctggacagcgtgagtgctgcggacacggccatttattactgtgcgagagagggaacttactacgctatggactactggggcaaagggagcacggtcaccgtgtcctcaggcggaggtggaagcggagggggaggatctggcggcggaggaagcggaggcgacatccagatgacccagagcccaagctccctgagtgcgtccgtgggcgaccgcgtgaccatcacttgcagatcctctcagtccatcgtgcactccaacggcaacacgtacctcgagtggtaccagcagaagcccgggaaggccccgaaactgctcatctacaaggtgagcaaccggttctccggcgtccccagccgcttctcagggtccggctcggggacggatttcaccttcacgattagcagcttgcagcccgaagacatcgccacgtactactgctttcagggaagtcacgtgccgcgtaccttcgggccgggcacgaaagtggatattaag

SEQ ID NO: 246 - DNA, 741 bp, Artificial Sequence
  humanized HLA-A*02 antigen binding domain
gaggtgcagctggtgcagtctggggccgagctgaagaagcctgggtcctcggtgaaggtgtcctgcaaggcttctggatacaccttcaccagctatcatatccagtgggtaaaacaggcccctggacaagggcttgagtggatcggatggatctaccctggcgatggttcaacacagtacaatgagaagttcaagggcaaagccacgcttaccgtggacaaatccacgaacacagcctacatggagctgagcagcctgagatctgaggacacggccgtatattactgtgcgagagagggaacttactacgctatggactactggggccaagggaccctggtcaccgtgtcctcaggcggaggtggaagcggagggggaggatctggcggcggaggaagcggaggcgacatccagatgacccagagcccatccaccctgagtgcgtccgtgggcgaccgcgtgaccatcacttgcagatcctctcagtccatcgtgcactccaacggcaacacgtacctcgagtggtaccagcagaagcccgggaaggccccgaaactgctcatctacaaggtgagcaaccggttctccggcgtccccagccgcttctcagggtccggctcggggacggatttcaccctcacgattagcagcttgcagcccgatgacttcgccacgtactactgctttcagggaagtcacgtgccgcgtaccttcgggcagggcacgaaagtggaagttaag

SEQ ID NO: 247 - DNA, 741 bp, Artificial Sequence
  humanized HLA-A*02 antigen binding domain
caggtgcagctggtgcagtctggggccgaggtgaagaagcctgggtcctcggtgaaggtgtcctgcaaggcttctggatacaccttcaccagctatcatatccagtgggtacgacaggcccctggacaagggcttgagtggatgggatggatctaccctggcgatggttcaacacagtacaatgagaagttcaagggcagagtcacgattaccgcggacaaatccacgagcacagcctacatggagctgagcagcctgagatctgaggacacggccgtatattactgtgcgagagagggaacttactacgctatggactactggggccaagggaccacggtcaccgtgtcctcaggcggaggtggaagcggagggggaggatctggcggcggaggaagcggaggcgagatcgtcctgacccagagcccagggaccctgagtttgtccccgggcgagcgcgcgaccctcagttgcagatcctctcagtccatcgtgcactccaacggcaacacgtacctcgagtggtaccagcagaagcccgggcaggccccgcgactgctcatctacaaggtgagcaaccggttctccggcatccccgaccgcttctcagggtccggctcggggacggatttcaccctcacgattagccgcttggagcccgaagacttcgccgtgtactactgctttcagggaagtcacgtgccgcgtaccttcggggggggcacgaaagtggaaattaag

SEQ ID NO: 248 - DNA, 741 bp, Artificial Sequence
  humanized HLA-A*02 antigen binding domain
caggtgaccctgaagcagtctggggccgaggtgaagaagcctgggtcctcggtgaaggtgtcctgcacggcttctggatacaccttcaccagctatcatgtcagctgggtacgacaggcccctggacaagggcttgagtggttgggaaggatctaccctggcgatggttcaacacagtacaatgagaagttcaagggcaaagtcacgattaccgcggacaaatccatggacacatccttcatggagctgaccagcctgacatctgaggacacggccgtatattactgtgcgagagagggaacttactacgctatggacctctggggccaagggaccctggtcaccgtgtcctcaggcggaggtggaagcggagggggaggatctggcggcggaggaagcggaggcgagatcgtcctgacccagagcccagggaccctgagtttgtccccgggcgagcgcgcgaccctcagttgcagatcctctcagtccatcgtgcactccaacggcaacacgtacctcgcgtggtaccagcagaagcccgggcaggccccgcgactgctcatctccaaggtgagcaaccggttctccggcgtccccgaccgcttctcagggtccggctcggggacggatttcaccctcacgattagccgcttggagcccgaagacttcgccgtgtactactgccaacagggaagtcacgtgccgcgtaccttcggggggggcacgaaagtggaaattaag

SEQ ID NO: 249 - DNA, 741 bp, Artificial Sequence
  humanized HLA-A*02 antigen binding domain
caggtgcagctggtgcagtctggggccgaggtgaagaagcctggggcctcggtgaaggtgtcctgcaaggcttctggatacaccttcaccagctatcatatgcactgggtacgacaggcccctggacaaaggcttgagtggatgggatggatctaccctggcgatggttcaacacagtacaatgagaagttcaagggcaaagtcacgattacccgggacacatccgcgagcacagcctacatggagctgagcagcctgagatctgaggacacggccgtatattactgtgcgagagagggaacttactacgctatggactactggggccaagggaccctggtcaccgtgtcctcaggcggaggtggaagcggagggggaggatctggcggcggaggaagcggaggcgacatcgtcatgacccagaccccactgtccctgcctgtgaccccgggcgagcccgcgagcatcagttgcagatcctctcagtccatcgtgcactccaacggcaacacgtacctcgactggtacctgcagaagcccgggcagtccccgcaactgctcatctacaaggtgagcaaccggttctccggcgtccccgaccgcttctcagggtccggctcggggacggatttcaccctcaagattagccgcgtggaggccgaagacgtcggcgtgtactactgcatgcagggaagtcacgtgccgcgtaccttcggggggggcacgaaagtggaaattaag

SEQ ID NO: 250 - protein, 244 aa, Artificial Sequence
  HLA-B*07 antigen binding domain 1.10_scFv
QVQLQESGPGLVKPSQTLSLTCTVSGYSITSGYSWHWIRQPPGKGLEWIGYIHFSGSTHYHPSLKSRVTISVDTSKNQFSLKLSSVTAADTAVYYCARGGVVSHYAMDCWGQGTTVTVSSGGGGSGGGGSGGGGSGGDIQMTQSPSSLSASVGDRVTITCRASENIYSNLAWYQQKPGKAPKLLIYAATYLPDGVPSRFSGSGSGTDFTLTISSLQPEDFATYYCQHFWVTPYTFGGGTKVEIK

SEQ ID NO: 251 - protein, 244 aa, Artificial Sequence
  HLA-B*07 antigen binding domain 1.9_scFv
EVQLVESGGGLVKPGGSLRLSCAASGYSITSGYSWHWVRQAPGKGLEWVSYIHFSGSTHYHPSLKSRFTISRDNAKNSLYLQMNSLRAEDTAVYYCARGGVVSHYAMDCWGQGTTVTVSSGGGGSGGGGSGGGGSGGDIQMTQSPSSVSASVGDRVTITCRASENIYSNLAWYQQKPGKAPKLLIYAATYLPDGVPSRFSGSGSGTDFTLTISSLQPEDFATYYCQHFWVTPYTFGGGTKVEIK

SEQ ID NO: 252 - protein, 244 aa, Artificial Sequence
  HLA-B*07 antigen binding domain 1.8_scFv
EVQLVESGGGLVKPGGSLRLSCAASGYSITSGYSWHWVRQAPGKGLEWVGYIHFSGSTHYHPSLKSRFTISRDDSKNTLYLQMNSLKTEDTAVYYCARGGVVSHYAMDCWGQGTTVTVSSGGGGSGGGGSGGGGSGGEIVLTQSPATLSLSPGERATLSCRASENIYSNLAWYQQKPGQAPRLLIYAATYLPDGIPARFSGSGSGTDFTLTISSLEPEDFAVYYCQHFWVTPYTFGGGTKVEIK

SEQ ID NO: 253 - protein, 244 aa, Artificial Sequence
  HLA-B*07 antigen binding domain 1.7_scFv
QVQLQQSGPGLVKPSQTLSLTCAISGYSITSGYSWHWIRQSPSRGLEWLGYIHFSGSTHYHPSLKSRITINPDTSKNQFSLQLNSVTPEDTAVYYCARGGVVSHYAMDCWGQGTTVTVSSGGGGSGGGGSGGGGSGGEIVLTQSPATLSLSPGERATLSCRASENIYSNLAWYQQKPGQAPRLLIYAATYLPDGIPARFSGSGSGTDFTLTISRLEPEDFAVYYCQHFWVTPYTFGGGTKVEIK

SEQ ID NO: 254 - protein, 244 aa, Artificial Sequence
  HLA-B*07 antigen binding domain 1.6_scFv
EVQLVESGGGLVKPGGSLRLSCAASGYSITSGYSWHWVRQAPGKGLEWVGYIHFSGSTHYHPSLKSRFTISRDDSKNTLYLQMNSLKTEDTAVYYCARGGVVSHYAMDCWGQGTTVTVSSGGGGSGGGGSGGGGSGGDIQMTQSPSSVSASVGDRVTITCRASENIYSNLAWYQQKPGKAPKLLIYAATYLPDGVPSRFSGSGSGTDFTLTISSLQPEDFATYYCQHFWVTPYTFGGGTKVEIK

SEQ ID NO: 255 - protein, 244 aa, Artificial Sequence
  HLA-B*07 antigen binding domain 1.5_scFv
EVQLVESGGGLVQPGGSLRLSCAASGYSITSGYSWHWVRQAPGKGLEWVSYIHFSGSTHYHPSLKSRFTISRDNSKNTLYLQMNSLRAEDTAVYYCARGGVVSHYAMDCWGQGTTVTVSSGGGGSGGGGSGGGGSGGDIQMTQSPSSLSASVGDRVTITCRASENIYSNLAWYQQKPGKAPKLLIYAATYLPDGVPSRFSGSGSGTDFTLTISSLQPEDFATYYCQHFWVTPYTFGGGTKVEIK

SEQ ID NO: 256 - protein, 244 aa, Artificial Sequence
  HLA-B*07 antigen binding domain 1.4_scFv
EVQLVESGGGLVKPGGSLRLSCAASGYSITSGYSWHWVRQAPGKGLEWVGYIHFSGSTHYHPSLKSRFTISRDDSKNTLYLQMNSLKTEDTAVYYCARGGVVSHYAMDCWGQGTTVTVSSGGGGSGGGGSGGGGSGGDIQMTQSPSSLSASVGDRVTITCRASENIYSNLAWYQQKPGKAPKLLIYAATYLPDGVPSRFSGSGSGTDFTLTISSLQPEDFATYYCQHFWVTPYTFGGGTKVEIK

SEQ ID NO: 257 - protein, 244 aa, Artificial Sequence
  HLA-B*07 antigen binding domain 1.3_scFv
QVQLQQWGAGLLKPSETLSLTCAVYGYSITSGYSWHWIRQPPGKGLEWIGYIHFSGSTHYHPSLKSRVTISVDTSKNQFSLKLSSVTAADTAVYYCARGGVVSHYAMDCWGQGTTVTVSSGGGGSGGGGSGGGGSGGDIQMTQSPSSLSASVGDRVTITCRASENIYSNLAWYQQKPGKAPKLLIYAATYLPDGVPSRFSGSGSGTDFTLTISSLQPEDFATYYCQHFWVTPYTFGGGTKVEIK

SEQ ID NO: 258 - protein, 244 aa, Artificial Sequence
  HLA-B*07 antigen binding domain 1.2_scFv
QVQLQESGPGLVKPSQTLSLTCTVSGYSITSGYSWHWIRQHPGKGLEWIGYIHFSGSTHYHPSLKSRVTISVDTSKNQFSLKLSSVTAADTAVYYCARGGVVSHYAMDCWGQGTTVTVSSGGGGSGGGGSGGGGSGGDIQMTQSPSSLSASVGDRVTITCRASENIYSNLAWYQQKPGKAPKLLIYAATYLPDGVPSRFSGSGSGTDFTLTISSLQPEDFATYYCQHFWVTPYTFGGGTKVEIK

SEQ ID NO: 259 - protein, 244 aa, Artificial Sequence
  HLA-B*07 antigen binding domain 1.1_scFv
QVQLQQSGPGLVKPSQTLSLTCAISGYSITSGYSWHWIRQSPSRGLEWLGYIHFSGSTHYHPSLKSRITINPDTSKNQFSLQLNSVTPEDTAVYYCARGGVVSHYAMDCWGQGTTVTVSSGGGGSGGGGSGGGGSGGDIQMTQSPSSLSASVGDRVTITCRASENIYSNLAWYQQKPGKAPKLLIYAATYLPDGVPSRFSGSGSGTDFTLTISSLQPEDFATYYCQHFWVTPYTFGGGTKVEIK

SEQ ID NO: 260 - protein, 243 aa, Artificial Sequence
  HLA-A*11 antigen binding domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARHYYYYSMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 261 - DNA, 729 bp, Artificial Sequence
  HLA-A*11 antigen binding domain
caggtgcagctgcaggaaagcggccctggcctggtgaaacccagccagaccctgagcctgacctgcacagtgtccggcggctcgatcagcagcggcggctactactggtcctggatcagacagccccctggcaagggcctggaatggatcggctacatctactacagcggcagcacctactacaaccccagcctgaagtccagagtgaccatcagcgtggacaccagcaagaaccagttcagcctgaagctgagcagcgtgacagccgccgacaccgctgtgtattactgtgcgagacactactactactactccatggacgtctggggcaaagggaccacggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 262 - protein, 244 aa, Artificial Sequence
  HLA-A*11 antigen binding domain
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHRHMRLSCFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 263 - DNA, 732 bp, Artificial Sequence
  HLA-A*11 antigen binding domain
cagatcaccctgaaagagtccggccccaccctggtgaaacccacccagaccctgaccctgacatgcaccttcagcggcttcagcctgagcacctctggcgtgggcgtgggctggatcagacagcctcccggcaaggccctggaatggctggccctgatctactggaacgacgacaagcggtacagccccagcctgaagtcccggctgaccatcaccaaggacacctcgaagaaccaggtggtgctgaccatgacaaacatggaccccgtggacaccgccacatattactgtgcacacagacacatgcgtttaagctgttttgactactggggccagggaaccctggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 264 - protein, 245 aa, Artificial Sequence
  HLA-A*11 antigen binding domain
QVQLVQSGAEVKKPGASVKVSCKASGYTFTSYAMHWVRQAPGQRLEWMGWINAGNGNTKYSQKFQGRVTITRDTSASTAYMELSSLRSEDTAVYYCAREGNGANPDAFDIWGQGTMVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 265 - DNA, 735 bp, Artificial Sequence
  HLA-A*11 antigen binding domain
caggtgcagctggtgcagtctggcgccgaagtgaagaaacctggcgcctccgtgaaggtgtcctgcaaggccagcggctacaccttcaccagctacgccatgcactgggttcgacaggcccctggccagagactggaatggatgggctggatcaacgccggcaacggcaacaccaagtacagccagaaattccagggcagagtgaccatcacccgggacaccagcgccagcaccgcctacatggaactgagcagcctgcggagcgaggacaccgctgtgtattactgtgcgagagaaggaaatggtgccaaccctgatgcttttgatatctggggccaagggacaatggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 266 - protein, 243 aa, Artificial Sequence
  HLA-A*11 antigen binding domain
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARDLPGSYWYFDLWGRGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 267 - DNA, 729 bp, Artificial Sequence
  HLA-A*11 antigen binding domain
gaagtgcagctggtggaaagcggcggaggcctggtgcagcctggcggcagcctgagactgtcttgcgccgccagcggcttcaccttcagcagctacgacatgcactgggtccgccaggccaccggcaagggactggaatgggtgtccgccatcggcacagccggcgacacttactaccccggcagcgtgaagggccggttcaccatcagcagagagaacgccaagaacagcctgtacctgcagatgaacagccttcgagccggcgataccgccgtgtattactgtgcaagagatctccctggtagctactggtacttcgatctctggggccgtggcaccctggtcactgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 268 - protein, 243 aa, Artificial Sequence
  HLA-A*11 antigen binding domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARHYYYYYLDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 269 - DNA, 729 bp, Artificial Sequence
  HLA-A*11 antigen binding domain
caggtgcagctgcaggaaagcggccctggcctggtgaaacccagccagaccctgagcctgacctgcacagtgtccggcggctcgatcagcagcggcggctactactggtcctggatcagacagccccctggcaagggcctggaatggatcggctacatctactacagcggcagcacctactacaaccccagcctgaagtccagagtgaccatcagcgtggacaccagcaagaaccagttcagcctgaagctgagcagcgtgacagccgccgacaccgctgtgtattactgtgcgagacactactactactactacctggacgtctggggcaaagggaccacggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 270 - protein, 243 aa, Artificial Sequence
  HLA-A*11 antigen binding domain
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCCLGVLLYNWFDPWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 271 - DNA, 729 bp, Artificial Sequence
  HLA-A*11 antigen binding domain
gaagtgcagctggtggaaagcggcggaggcctggtgcagcctggcggcagcctgagactgtcttgcgccgccagcggcttcaccttcagcagctactggatgcactgggtccgccaggcccctggcaagggactggtctgggtgtctcgaatcaacagcgacggcagcagcaccagctacgccgacagcgtgaagggccggttcaccatcagccgggacaacgccaagaacaccctgtacctgcagatgaacagcctgcgggccgaggacaccgccgtgtattactgttgtttgggtgttttattatacaactggttcgacccctggggccagggaaccctggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 272 - protein, 242 aa, Artificial Sequence
  HLA-A*11 antigen binding domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARHYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 273 - DNA, 726 bp, Artificial Sequence
  HLA-A*11 antigen binding domain
caggtgcagctgcaggaaagcggccctggcctggtgaaacccagccagaccctgagcctgacctgcacagtgtccggcggctcgatcagcagcggcggctactactggtcctggatcagacagccccctggcaagggcctggaatggatcggctacatctactacagcggcagcacctactacaaccccagcctgaagtccagagtgaccatcagcgtggacaccagcaagaaccagttcagcctgaagctgagcagcgtgacagccgccgacaccgctgtgtattactgtgcgagacactactactactacatggacgtctggggcaaagggaccacggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 274 - protein, 243 aa, Artificial Sequence
  HLA-A*11 antigen binding domain
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHKTTSFYFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 275 - DNA, 729 bp, Artificial Sequence
  HLA-A*11 antigen binding domain
cagatcaccctgaaagagtccggccccaccctggtgaaacccacccagaccctgaccctgacatgcaccttcagcggcttcagcctgagcacctctggcgtgggcgtgggctggatcagacagcctcccggcaaggccctggaatggctggccctgatctactggaacgacgacaagcggtacagccccagcctgaagtcccggctgaccatcaccaaggacacctcgaagaaccaggtggtgctgaccatgacaaacatggaccccgtggacaccgccacatattactgtgcacacaaaacgacgtcgttttactttgactactggggccagggaaccctggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 276 - protein, 243 aa, Artificial Sequence
  HLA-A*11 antigen binding domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARHYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 277 - DNA, 729 bp, Artificial Sequence
  HLA-A*11 antigen binding domain
caggtgcagctgcaggaaagcggccctggcctggtgaaacccagccagaccctgagcctgacctgcacagtgtccggcggctcgatcagcagcggcggctactactggtcctggatcagacagccccctggcaagggcctggaatggatcggctacatctactacagcggcagcacctactacaaccccagcctgaagtccagagtgaccatcagcgtggacaccagcaagaaccagttcagcctgaagctgagcagcgtgacagccgccgacaccgctgtgtattactgtgcgagacactactactactactacatggacgtctggggcaaagggaccacggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 278 - protein, 240 aa, Artificial Sequence
  HLA-C*07 antigen binding domain C7-45
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAVSFDWFDPWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 279 - protein, 248 aa, Artificial Sequence
  HLA-C*07 antigen binding domain C7-44
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARERSISPYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 280 - protein, 247 aa, Artificial Sequence
  HLA-C*07 antigen binding domain C7-43
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARDSVIWYWFDPWGQGTLVTVSSGGGGSGGGGSGGGGSGGQSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTKLTVL

SEQ ID NO: 281 - protein, 249 aa, Artificial Sequence
  HLA-C*07 antigen binding domain C7-42
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREEILPRLSYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 282 - protein, 245 aa, Artificial Sequence
  HLA-C*07 antigen binding domain C7-41
QVQLVQSGSELKKPGASVKVSCKASGYTFTSYAMNWVRQAPGQGLEWMGWINTNTGNPTYAQGFTGRFVFSFDTSVSTAYLQICSLKAEDTAVYYCARGGRAHSSWYFDLWGRGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 283 - protein, 251 aa, Artificial Sequence
  HLA-C*07 antigen binding domain C7-40
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDRIKILPRLGYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 284 - protein, 246 aa, Artificial Sequence
  HLA-C*07 antigen binding domain C7-39
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDTVIHYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 285 - protein, 250 aa, Artificial Sequence
  HLA-C*07 antigen binding domain C7-38
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDVIVEVFLSYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 286 - protein, 246 aa, Artificial Sequence
  HLA-C*07 antigen binding domain C7-37
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDIFIHYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 287 - protein, 247 aa, Artificial Sequence
  HLA-C*07 antigen binding domain C7-36
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCARDGTFYSYSPYYFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 288 - protein, 251 aa, Artificial Sequence
  HLA-C*07 antigen binding domain C7-35
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREWIKILPRLGYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 289 - protein, 246 aa, Artificial Sequence
  HLA-C*07 antigen binding domain C7-34
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDRSLYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 290 - protein, 248 aa, Artificial Sequence
  HLA-C*07 antigen binding domain C7-33
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDKILAPNYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 291 - protein, 250 aa, Artificial Sequence
  HLA-C*07 antigen binding domain C7-32
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREKSWKYFYYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 292 - protein, 249 aa, Artificial Sequence
  HLA-C*07 antigen binding domain C7-31
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARENTSTIPYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 293 - protein, 253 aa, Artificial Sequence
  HLA-C*07 antigen binding domain C7-30
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREDVDKNTSTIYYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 294 - protein, 250 aa, Artificial Sequence
  HLA-C*07 antigen binding domain C7-29
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDGGDIVSSSAIYWYFDLWGRGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIK

SEQ ID NO: 295 - protein, 248 aa, Artificial Sequence
  HLA-C*07 antigen binding domain C7-28
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDLILPPYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 296 - protein, 253 aa, Artificial Sequence
  HLA-C*07 antigen binding domain C7-27
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARETWIKILPRYYYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 297 - protein, 246 aa, Artificial Sequence
  HLA-C*07 antigen binding domain C7-26
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDLSRYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 298 - protein, 242 aa, Artificial Sequence
  HLA-C*07 antigen binding domain C7-25
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCAREHIVLCFDYWGQGTLVTVSSGGGGSGGGGSGGGGSGGDIQMTQSPSSLSASVGDRVTITCRASQGISSWLAWYQQKPEKAPKSLIYAASSLQSGVPSRFSGSGSGTDFTLTISSLQPEDFATYYCQQYNSYPLTFGGGTKVEIK

SEQ ID NO: 299 - protein, 249 aa, Artificial Sequence
  HLA-C*07 antigen binding domain C7-24
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDKILPRPYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 300 - protein, 244 aa, Artificial Sequence
  HLA-C*07 antigen binding domain C7-23
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGSNEYFQHWGQGTLVTVSSGGGGSGGGGSGGGGSGGQSALTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNWVFGGGTKLTVL

SEQ ID NO: 301 - protein, 242 aa, Artificial Sequence
  HLA-C*07 antigen binding domain C7-22
QVQLVQSGSELKKPGASVKVSCKASGYTFTSYAMNWVRQAPGQGLEWMGWINTNTGNPTYAQGFTGRFVFSFDTSVSTAYLQICSLKAEDTAVYYCARGTSYWYFDLWGRGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 302 - protein, 248 aa, Artificial Sequence
  HLA-C*07 antigen binding domain C7-21
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREEIVEVFYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 303 - protein, 241 aa, Artificial Sequence
  HLA-C*07 antigen binding domain C7-20
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKVDDYYFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 304 - protein, 247 aa, Artificial Sequence
  HLA-C*07 antigen binding domain C7-19
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCAWSTNILLSYTKAFDIWGQGTMVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 305 - protein, 246 aa, Artificial Sequence
  HLA-C*07 antigen binding domain C7-18
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDKTYYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 306 - protein, 253 aa, Artificial Sequence
  HLA-C*07 antigen binding domain C7-17
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREKYFHDKYFHDYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 307 - protein, 246 aa, Artificial Sequence
  HLA-C*07 antigen binding domain C7-16
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDTSVYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 308 - protein, 248 aa, Artificial Sequence
  HLA-C*07 antigen binding domain C7-15
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREKILPYYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 309 - protein, 257 aa, Artificial Sequence
  HLA-C*07 antigen binding domain C7-14
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCAIQWIYIYINPRGFIFLHDAFDIWGQGTMVTVSSGGGGSGGGGSGGGGSGGQSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTKLTVL

SEQ ID NO: 310 - protein, 248 aa, Artificial Sequence
  HLA-C*07 antigen binding domain C7-13
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAKEDVDFHHDAFDIWGQGTMVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 311 - protein, 253 aa, Artificial Sequence
  HLA-C*07 antigen binding domain C7-12
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREGVDKNTSTIYYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 312 - protein, 241 aa, Artificial Sequence
  HLA-C*07 antigen binding domain C7-11
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCARDRRGYFDLWGRGTLVTVSSGGGGSGGGGSGGGGSGGDIQMTQSPSSLSASVGDRVTITCRASQGISSWLAWYQQKPEKAPKSLIYAASSLQSGVPSRFSGSGSGTDFTLTISSLQPEDFATYYCQQYNSYPLTFGGGTKVEIK

SEQ ID NO: 313 - protein, 248 aa, Artificial Sequence
  HLA-C*07 antigen binding domain C7-10
EVQLVQSGAEVKKPGATVKISCKVSGYTFTDYYMHWVQQAPGKGLEWMGLVDPEDGETIYAEKFQGRVTITADTSTDTAYMELSSLRSEDTAVYYCATGIHVDIRSMEDWFDPWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 314 - protein, 246 aa, Artificial Sequence
  HLA-C*07 antigen binding domain C7-9
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDIGTSYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 315 - protein, 249 aa, Artificial Sequence
  HLA-C*07 antigen binding domain C7-8
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREVVEVFLYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 316 - protein, 246 aa, Artificial Sequence
  HLA-C*07 antigen binding domain C7-7
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDLYYYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 317 - protein, 256 aa, Artificial Sequence
  HLA-C*07 antigen binding domain C7-6
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARESWKYFYPRGSIFIHYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 318 - protein, 248 aa, Artificial Sequence
  HLA-C*07 antigen binding domain C7-5
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDRIVEVFYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 319 - protein, 250 aa, Artificial Sequence
  HLA-C*07 antigen binding domain C7-4
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREKYFHDWLYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 320 - protein, 250 aa, Artificial Sequence
  HLA-C*07 antigen binding domain C7-3
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDLVDKNTSYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 321 - protein, 244 aa, Artificial Sequence
  HLA-C*07 antigen binding domain C7-2
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARVQNEYFQHWGQGTLVTVSSGGGGSGGGGSGGGGSGGQSALTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNWVFGGGTKLTVL

SEQ ID NO: 322 - protein, 239 aa, Artificial Sequence
  HLA-C*07 antigen binding domain C7-1
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCATANWFDPWGQGTLVTVSSGGGGSGGGGSGGGGSGGDIQMTQSPSSVSASVGDRVTITCRASQGISSWLAWYQQKPGKAPKLLIYAASSLQSGVPSRFSGSGSGTDFTLTISSLQPEDFATYYCQQANSFPLTFGGGTKVEIK

SEQ ID NO: 323 - protein, 244 aa, Artificial Sequence
  HLA-A*03 scFv Sequence 15
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARERVSQRGAFDIWGQGTMVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 324 - protein, 243 aa, Artificial Sequence
  HLA-A*03 scFv Sequence 16
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCARGNPDKDPFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 325 - protein, 245 aa, Artificial Sequence
  HLA-A*03 scFv Sequence 17
QVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCARDFYCTNWYFDLWGRGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 326 - protein, 244 aa, Artificial Sequence
  HLA-A*03 scFv Sequence 18
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARESSSGSYWYFDLWGRGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 327 - protein, 250 aa, Artificial Sequence
  HLA-A*03 scFv Sequence 19
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARDSGYKYNLYYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 328 - protein, 249 aa, Artificial Sequence
  HLA-A*03 scFv Sequence 20
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGGDLSHYYYYMDVWGKGTTVTVSSGGGGSGGGGSGGGGSGGQTVVTQEPSLTVSPGGTVTLTCASSTGAVTSGYYPNWFQQKPGQAPRALIYSTSNKHSWTPARFSGSLLGGKAALTLSGVQPEDEAEYYCLLYYGGAQWVFGGGTKLTVL

SEQ ID NO: 329 - protein, 246 aa, Artificial Sequence
  HLA-A*03 scFv Sequence 21
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARENRRYNSCYYFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 330 - protein, 249 aa, Artificial Sequence
  HLA-A*03 scFv Sequence 22
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGGDLSHYYYYLDVWGKGTTVTVSSGGGGSGGGGSGGGGSGGQTVVTQEPSLTVSPGGTVTLTCASSTGAVTSGYYPNWFQQKPGQAPRALIYSTSNKHSWTPARFSGSLLGGKAALTLSGVQPEDEAEYYCLLYYGGAQWVFGGGTKLTVL

SEQ ID NO: 331 - protein, 245 aa, Artificial Sequence
  HLA-A*03 scFv Sequence 23
EVQLVESGGGLVQPGGSLRLSCAASGFTVSSNYMSWVRQAPGKGLEWVSVIYSGGSTYYADSVKGRFTISRDNSKNTLYLQMNSLRAEDTAVYYCARATLLSLSYDAFDIWGQGTMVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 332 - protein, 248 aa, Artificial Sequence
  HLA-A*03 scFv Sequence 24
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGGDLSHYYYMDVWGKGTTVTVSSGGGGSGGGGSGGGGSGGQTVVTQEPSLTVSPGGTVTLTCASSTGAVTSGYYPNWFQQKPGQAPRALIYSTSNKHSWTPARFSGSLLGGKAALTLSGVQPEDEAEYYCLLYYGGAQWVFGGGTKLTVL

SEQ ID NO: 333 - protein, 241 aa, Artificial Sequence
  HLA-A*03 scFv Sequence 25
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARERDRWFDPWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 334 - protein, 247 aa, Artificial Sequence
  HLA-A*03 scFv Sequence 26
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARETPPSLGAFDIWGQGTMVTVSSGGGGSGGGGSGGGGSGGQSALTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNWVFGGGTKLTVL

SEQ ID NO: 335 - protein, 251 aa, Artificial Sequence
  HLA-A*03 scFv Sequence 27
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCAREAYCLSDSYWYFDLWGRGTLVTVSSGGGGSGGGGSGGGGSGGQSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTKLTVL

SEQ ID NO: 336 - protein, 248 aa, Artificial Sequence
  HLA-A*03 scFv Sequence 28
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARESWKYFYPRGYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 337 - protein, 248 aa, Artificial Sequence
  A1-9
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGGWTAWYYYMDVWGKGTTVTVSSGGGGSGGGGSGGGGSGGQTVVTQEPSLTVSPGGTVTLTCASSTGAVTSGYYPNWFQQKPGQAPRALIYSTSNKHSWTPARFSGSLLGGKAALTLSGVQPEDEAEYYCLLYYGGAQWVFGGGTKLTVL

SEQ ID NO: 338 - protein, 244 aa, Artificial Sequence
  A1-8
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCARAKYYYMDVWGKGTTVTVSSGGGGSGGGGSGGGGSGGQSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTKLTVL

SEQ ID NO: 339 - protein, 248 aa, Artificial Sequence
  A1-7
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDQVDKNTYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 340 - protein, 243 aa, Artificial Sequence
  A1-6
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARACQLAEYFQHWGQGTLVTVSSGGGGSGGGGSGGGGSGGDIQMTQSPSSVSASVGDRVTITCRASQGISSWLAWYQQKPGKAPKLLIYAASSLQSGVPSRFSGSGSGTDFTLTISSLQPEDFATYYCQQANSFPLTFGGGTKVEIK

SEQ ID NO: 341 - protein, 248 aa, Artificial Sequence
  A1-5
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDRVDKNTSYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 342 - protein, 245 aa, Artificial Sequence
  A1-4
QVQLQESGPGLVKPSDTLSLTCAVSGYSISSSNWWGWIRQPPGKGLEWIGYIYYSGSTYYNPSLKSRVTMSVDTSKNQFSLKLSSVTAVDTAVYYCARRVQLKLVHWFDPWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 343 - protein, 245 aa, Artificial Sequence
  A1-3
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCATYYDYVTVFYFQHWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 344 - protein, 245 aa, Artificial Sequence
  A1-2
QLQLQESGSGLVKPSQTLSLTCAVSGGSISSGGYSWSWIRQPPGKGLEWIGYIYHSGSTYYNPSLKSRVTISVDRSKNQFSLKLSSVTAADTAVYYCARESYPSFYAFDIWGQGTMVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 345 - protein, 249 aa, Artificial Sequence
  A1-1
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHSNMWSYSLNDYYFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 346 - protein, 11 aa, Artificial Sequence
  CDR-L1
RASQSISSYLN

SEQ ID NO: 347 - protein, 14 aa, Artificial Sequence
  CDR-L1
ASSTGAVTSGYYPN

SEQ ID NO: 348 - protein, 14 aa, Artificial Sequence
  CDR-L1
TGTSSDVGGYNYVS

SEQ ID NO: 349 - protein, 13 aa, Artificial Sequence
  CDR-L1
SGSSSNIGSNTVN

SEQ ID NO: 350 - protein, 11 aa, Artificial Sequence
  CDR-L1
RASENIYSNLA

SEQ ID NO: 351 - protein, 11 aa, Artificial Sequence
  CDR-L1
RASQGISSALA

SEQ ID NO: 352 - protein, 11 aa, Artificial Sequence
  CDR-L1
RASQGISSWLA

SEQ ID NO: 353 - protein, 7 aa, Artificial Sequence
  CDR-L2
AASSLQS

SEQ ID NO: 354 - protein, 7 aa, Artificial Sequence
  CDR-L2
STSNKHS

SEQ ID NO: 355 - protein, 7 aa, Artificial Sequence
  CDR-L2
EVSKRPS

SEQ ID NO: 356 - protein, 7 aa, Artificial Sequence
  CDR-L2
SNNQRPS

SEQ ID NO: 357 - protein, 7 aa, Artificial Sequence
  CDR-L2
AATYLPD

SEQ ID NO: 358 - protein, 9 aa, Artificial Sequence
  CDR-L3
QQSYSTPLT

SEQ ID NO: 359 - protein, 10 aa, Artificial Sequence
  CDR-L3
LLYYGGAQWV

SEQ ID NO: 360 - protein, 10 aa, Artificial Sequence
  CDR-L3
SSYAGSNNWV

SEQ ID NO: 361 - protein, 11 aa, Artificial Sequence
  CDR-L3
AAWDDSLNGWV

SEQ ID NO: 362 - protein, 9 aa, Artificial Sequence
  CDR-L3
QHFWVTPYT

SEQ ID NO: 363 - protein, 9 aa, Artificial Sequence
  CDR-L3
QQYNSYPLT

SEQ ID NO: 364 - protein, 9 aa, Artificial Sequence
  CDR-L3
QQANSFPLT

SEQ ID NO: 365 - protein, 5 aa, Artificial Sequence
  CDR-H1
SYGIS

SEQ ID NO: 366 - protein, 5 aa, Artificial Sequence
  CDR-H1
SYSMN

SEQ ID NO: 367 - protein, 7 aa, Artificial Sequence
  CDR-H1
SGSYYWS

SEQ ID NO: 368 - protein, 5 aa, Artificial Sequence
  CDR-H1
SYYWS

SEQ ID NO: 369 - protein, 5 aa, Artificial Sequence
  CDR-H1
SYWIG

SEQ ID NO: 370 - protein, 5 aa, Artificial Sequence
  CDR-H1
SNYMS

SEQ ID NO: 371 - protein, 7 aa, Artificial Sequence
  CDR-H1
SSSYYWG

SEQ ID NO: 372 - protein, 7 aa, Artificial Sequence
  CDR-H1
SGGYYWS

SEQ ID NO: 373 - protein, 6 aa, Artificial Sequence
  CDR-H1
SGYSWH

SEQ ID NO: 374 - protein, 7 aa, Artificial Sequence
  CDR-H1
TSGVGVG

SEQ ID NO: 375 - protein, 5 aa, Artificial Sequence
  CDR-H1
SYWMH

SEQ ID NO: 376 - protein, 5 aa, Artificial Sequence
  CDR-H1
SYDMH

SEQ ID NO: 377 - protein, 5 aa, Artificial Sequence
  CDR-H1
SYAMH

SEQ ID NO: 378 - protein, 5 aa, Artificial Sequence
  CDR-H1
SYAMS

SEQ ID NO: 379 - protein, 5 aa, Artificial Sequence
  CDR-H1
SYAMN

SEQ ID NO: 380 - protein, 5 aa, Artificial Sequence
  CDR-H1
DYYMS

SEQ ID NO: 381 - protein, 7 aa, Artificial Sequence
  CDR-H1
SNSAAWN

SEQ ID NO: 382 - protein, 5 aa, Artificial Sequence
  CDR-H1
DYYMH

SEQ ID NO: 383 - protein, 6 aa, Artificial Sequence
  CDR-H1
SSNWWG

SEQ ID NO: 384 - protein, 5 aa, Artificial Sequence
  CDR-H1
SYDIN

SEQ ID NO: 385 - protein, 7 aa, Artificial Sequence
  CDR-H1
SGGYSWS

SEQ ID NO: 386 - protein, 17 aa, Artificial Sequence
  CDR-H2
WISAYNGNTNYAQKLQG

SEQ ID NO: 387 - protein, 17 aa, Artificial Sequence
  CDR-H2
YISSSSSTIYYADSVKG

SEQ ID NO: 388 - protein, 16 aa, Artificial Sequence
  CDR-H2
YIYYSGSTNYNPSLKS

SEQ ID NO: 389 - protein, 17 aa, Artificial Sequence
  CDR-H2
IIYPGDSDTRYSPSFQG

SEQ ID NO: 390 - protein, 16 aa, Artificial Sequence
  CDR-H2
VIYSGGSTYYADSVKG

SEQ ID NO: 391 - protein, 16 aa, Artificial Sequence
  CDR-H2
SIYYSGSTYYNPSLKS

SEQ ID NO: 392 - protein, 16 aa, Artificial Sequence
  CDR-H2
YIYYSGSTYYNPSLKS

SEQ ID NO: 393 - protein, 16 aa, Artificial Sequence
  CDR-H2
YIHFSGSTHYHPSLKS

SEQ ID NO: 394 - protein, 16 aa, Artificial Sequence
  CDR-H2
LIYWNDDKRYSPSLKS

SEQ ID NO: 395 - protein, 17 aa, Artificial Sequence
  CDR-H2
RINSDGSSTSYADSVKG

SEQ ID NO: 396 - protein, 16 aa, Artificial Sequence
  CDR-H2
AIGTAGDTYYPGSVKG

SEQ ID NO: 397 - protein, 17 aa, Artificial Sequence
  CDR-H2
WINAGNGNTKYSQKFQG

SEQ ID NO: 398 - protein, 17 aa, Artificial Sequence
  CDR-H2
AISGSGGSTYYADSVKG

SEQ ID NO: 399 - protein, 17 aa, Artificial Sequence
  CDR-H2
WINTNTGNPTYAQGFTG

SEQ ID NO: 400 - protein, 17 aa, Artificial Sequence
  CDR-H2
YISSSGSTIYYADSVKG

SEQ ID NO: 401 - protein, 18 aa, Artificial Sequence
  CDR-H2
RTYYRSKWYNDYAVSVKS

SEQ ID NO: 402 - protein, 17 aa, Artificial Sequence
  CDR-H2
LVDPEDGETIYAEKFQG

SEQ ID NO: 403 - protein, 17 aa, Artificial Sequence
  CDR-H2
WMNPNSGNTGYAQKFQG

SEQ ID NO: 404 - protein, 16 aa, Artificial Sequence
  CDR-H2
YIYHSGSTYYNPSLKS

SEQ ID NO: 405 - protein, 11 aa, Artificial Sequence
  CDR-H2
ERVSQRGAFDI

SEQ ID NO: 406 - protein, 10 aa, Artificial Sequence
  CDR-H2
GNPDKDPFDY

SEQ ID NO: 407 - protein, 11 aa, Artificial Sequence
  CDR-H2
DFYCTNWYFDL

SEQ ID NO: 408 - protein, 12 aa, Artificial Sequence
  CDR-H2
ESSSGSYWYFDL

SEQ ID NO: 409 - protein, 17 aa, Artificial Sequence
  CDR-H2
DSGYKYNLYYYYYYMDV

SEQ ID NO: 410 - protein, 13 aa, Artificial Sequence
  CDR-H2
GGDLSHYYYYMDV

SEQ ID NO: 411 - protein, 13 aa, Artificial Sequence
  CDR-H2
ENRRYNSCYYFDY

SEQ ID NO: 412 - protein, 13 aa, Artificial Sequence
  CDR-H2
GGDLSHYYYYLDV

SEQ ID NO: 413 - protein, 13 aa, Artificial Sequence
  CDR-H2
ATLLSLSYDAFDI

SEQ ID NO: 414 - protein, 12 aa, Artificial Sequence
  CDR-H2
GGDLSHYYYMDV

SEQ ID NO: 415 - protein, 8 aa, Artificial Sequence
  CDR-H2
ERDRWFDP

SEQ ID NO: 416 - protein, 11 aa, Artificial Sequence
  CDR-H2
ETPPSLGAFDI

SEQ ID NO: 417 - protein, 14 aa, Artificial Sequence
  CDR-H2
EAYCLSDSYWYFDL

SEQ ID NO: 418 - protein, 14 aa, Artificial Sequence
  CDR-H2
ESWKYFYPRGYMDV

SEQ ID NO: 419 - protein, 11 aa, Artificial Sequence
  CDR-H2
GGVVSHYAMDC

SEQ ID NO: 420 - protein, 9 aa, Artificial Sequence
  CDR-H2
HYYYYYMDV

SEQ ID NO: 421 - protein, 9 aa, Artificial Sequence
  CDR-H2
KTTSFYFDY

SEQ ID NO: 422 - protein, 8 aa, Artificial Sequence
  CDR-H2
HYYYYMDV

SEQ ID NO: 423 - protein, 10 aa, Artificial Sequence
  CDR-H2
GVLLYNWFDP

SEQ ID NO: 424 - protein, 9 aa, Artificial Sequence
  CDR-H2
HYYYYYLDV

SEQ ID NO: 425 - protein, 11 aa, Artificial Sequence
  CDR-H2
DLPGSYWYFDL

SEQ ID NO: 426 - protein, 12 aa, Artificial Sequence
  CDR-H2
EGNGANPDAFDI

SEQ ID NO: 427 - protein, 10 aa, Artificial Sequence
  CDR-H2
RHMRLSCFDY

SEQ ID NO: 428 - protein, 9 aa, Artificial Sequence
  CDR-H2
HYYYYSMDV

SEQ ID NO: 429 - protein, 7 aa, Artificial Sequence
  CDR-H2
SFDWFDP

SEQ ID NO: 430 - protein, 14 aa, Artificial Sequence
  CDR-H2
ERSISPYYYYYMDV

SEQ ID NO: 431 - protein, 10 aa, Artificial Sequence
  CDR-H2
DSVIWYWFDP

SEQ ID NO: 432 - protein, 15 aa, Artificial Sequence
  CDR-H2
EEILPRLSYYYYMDV

SEQ ID NO: 433 - protein, 12 aa, Artificial Sequence
  CDR-H2
GGRAHSSWYFDL

SEQ ID NO: 434 - protein, 17 aa, Artificial Sequence
  CDR-H3
DRIKILPRLGYYYYMDV

SEQ ID NO: 435 - protein, 12 aa, Artificial Sequence
  CDR-H3
DTVIHYYYYMDV

SEQ ID NO: 436 - protein, 16 aa, Artificial Sequence
  CDR-H3
DVIVEVFLSYYYYMDV

SEQ ID NO: 437 - protein, 12 aa, Artificial Sequence
  CDR-H3
DIFIHYYYYMDV

SEQ ID NO: 438 - protein, 14 aa, Artificial Sequence
  CDR-H3
DGTFYSYSPYYFDY

SEQ ID NO: 439 - protein, 17 aa, Artificial Sequence
  CDR-H3
EWIKILPRLGYYYYMDV

SEQ ID NO: 440 - protein, 12 aa, Artificial Sequence
  CDR-H3
DRSLYYYYYMDV

SEQ ID NO: 441 - protein, 14 aa, Artificial Sequence
  CDR-H3
DKILAPNYYYYMDV

SEQ ID NO: 442 - protein, 16 aa, Artificial Sequence
  CDR-H3
EKSWKYFYYYYYYMDV

SEQ ID NO: 443 - protein, 15 aa, Artificial Sequence
  CDR-H3
ENTSTIPYYYYYMDV

SEQ ID NO: 444 - protein, 19 aa, Artificial Sequence
  CDR-H3
EDVDKNTSTIYYYYYYMDV

SEQ ID NO: 445 - protein, 17 aa, Artificial Sequence
  CDR-H3
DGGDIVSSSAIYWYFDL

SEQ ID NO: 446 - protein, 14 aa, Artificial Sequence
  CDR-H3
DLILPPYYYYYMDV

SEQ ID NO: 447 - protein, 19 aa, Artificial Sequence
  CDR-H3
ETWIKILPRYYYYYYYMDV

SEQ ID NO: 448 - protein, 12 aa, Artificial Sequence
  CDR-H3
DLSRYYYYYMDV

SEQ ID NO: 449 - protein, 9 aa, Artificial Sequence
  CDR-H3
EHIVLCFDY

SEQ ID NO: 450 - protein, 15 aa, Artificial Sequence
  CDR-H3
DKILPRPYYYYYMDV

SEQ ID NO: 451 - protein, 8 aa, Artificial Sequence
  CDR-H3
GSNEYFQH

SEQ ID NO: 452 - protein, 9 aa, Artificial Sequence
  CDR-H3
GTSYWYFDL

SEQ ID NO: 453 - protein, 14 aa, Artificial Sequence
  CDR-H3
EEIVEVFYYYYMDV

SEQ ID NO: 454 - protein, 8 aa, Artificial Sequence
  CDR-H3
VDDYYFDY

SEQ ID NO: 455 - protein, 14 aa, Artificial Sequence
  CDR-H3
STNILLSYTKAFDI

SEQ ID NO: 456 - protein, 12 aa, Artificial Sequence
  CDR-H3
DKTYYYYYYMDV

SEQ ID NO: 457 - protein, 19 aa, Artificial Sequence
  CDR-H3
EKYFHDKYFHDYYYYYMDV

SEQ ID NO: 458 - protein, 12 aa, Artificial Sequence
  CDR-H3
DTSVYYYYYMDV

SEQ ID NO: 459 - protein, 14 aa, Artificial Sequence
  CDR-H3
EKILPYYYYYYMDV

SEQ ID NO: 460 - protein, 21 aa, Artificial Sequence
  CDR-H3
QWIYIYINPRGFIFLHDAFDI

SEQ ID NO: 461 - protein, 12 aa, Artificial Sequence
  CDR-H3
EDVDFHHDAFDI

SEQ ID NO: 462 - protein, 19 aa, Artificial Sequence
  CDR-H3
EGVDKNTSTIYYYYYYMDV

SEQ ID NO: 463 - protein, 8 aa, Artificial Sequence
  CDR-H3
DRRGYFDL

SEQ ID NO: 464 - protein, 15 aa, Artificial Sequence
  CDR-H3
GIHVDIRSMEDWFDP

SEQ ID NO: 465 - protein, 12 aa, Artificial Sequence
  CDR-H3
DIGTSYYYYMDV

SEQ ID NO: 466 - protein, 15 aa, Artificial Sequence
  CDR-H3
EVVEVFLYYYYYMDV

SEQ ID NO: 467 - protein, 12 aa, Artificial Sequence
  CDR-H3
DLYYYYYYYMDV

SEQ ID NO: 468 - protein, 22 aa, Artificial Sequence
  CDR-H3
ESWKYFYPRGSIFIHYYYYMDV

SEQ ID NO: 469 - protein, 14 aa, Artificial Sequence
  CDR-H3
DRIVEVFYYYYMDV

SEQ ID NO: 470 - protein, 16 aa, Artificial Sequence
  CDR-H3
EKYFHDWLYYYYYMDV

SEQ ID NO: 471 - protein, 16 aa, Artificial Sequence
  CDR-H3
DLVDKNTSYYYYYMDV

SEQ ID NO: 472 - protein, 8 aa, Artificial Sequence
  CDR-H3
VQNEYFQH

SEQ ID NO: 473 - protein, 6 aa, Artificial Sequence
  CDR-H3
ANWFDP

SEQ ID NO: 474 - protein, 12 aa, Artificial Sequence
  CDR-H3
GGWTAWYYYMDV

SEQ ID NO: 475 - protein, 8 aa, Artificial Sequence
  CDR-H3
AKYYYMDV

SEQ ID NO: 476 - protein, 14 aa, Artificial Sequence
  CDR-H3
DQVDKNTYYYYMDV

SEQ ID NO: 477 - protein, 10 aa, Artificial Sequence
  CDR-H3
ACQLAEYFQH

SEQ ID NO: 478 - protein, 14 aa, Artificial Sequence
  CDR-H3
DRVDKNTSYYYMDV

SEQ ID NO: 479 - protein, 12 aa, Artificial Sequence
  CDR-H3
RVQLKLVHWFDP

SEQ ID NO: 480 - protein, 12 aa, Artificial Sequence
  CDR-H3
YYDYVTVFYFQH

SEQ ID NO: 481 - protein, 11 aa, Artificial Sequence
  CDR-H3
ESYPSFYAFDI

SEQ ID NO: 482 - protein, 15 aa, Artificial Sequence
  CDR-H3
SNMWSYSLNDYYFDY

SEQ ID NO: 483 - protein, 64 aa, Artificial Sequence
  Hinge (iTIM hinge)
YGSQSSKPYLLTHPSDPLELVVSGPSGGPSSPTTGPTSTSGPEDQPLTPTGSDPQSGLGRHLGV

SEQ ID NO: 484 - protein, 44 aa, Artificial Sequence
  Short hinge 2
VVSGPSGGPSSPTTGPTSTSGPEDQPLTPTGSDPQSGLGRHLGV

SEQ ID NO: 485 - protein, 67 aa, Artificial Sequence
  Long hinge 1
AGSGGSGGSGGSPVPSTPPTPSPSTPPTPSPSGGSGNSSGSGGSPVPSTPPTPSPSTPPTPSPSASV

SEQ ID NO: 486 - protein, 75 aa, Artificial Sequence
  Long hinge 2
AGSGGSGGSGGSPVPSTPPTNSSSTPPTPSPSPVPSTPPTNSSSTPPTPSPSPVPSTPPTNSSSTPPTPSPSASV

SEQ ID NO: 487 - protein, 85 aa, Artificial Sequence
  2x short hinge
VVSGPSGGPSSPTTGPTSTSGPEDQPLTPTGSDPQSGLGRHVVSGPSGGPSSPTTGPTSTSGPEDQPLTPTGSDPQSGLGRHLGV

SEQ ID NO: 488 - protein, 32 aa, Artificial Sequence
  Hinge (truncated)
TTGPTSTSGPEDQPLTPTGSDPQSGLGRHLGV

SEQ ID NO: 489 - protein, 18 aa, Unknown
  T2A self-cleaving peptide
EGRGSLLTCGDVEENPGP

SEQ ID NO: 490 - protein, 20 aa, Unknown
  E2A self-cleaving peptide
QCTNYALLKLAGDVESNPGP

SEQ ID NO: 491 - protein, 22 aa, Unknown
  F2A self-cleaving peptide
VKQTLNFDLLKLAGDVESNPGP

SEQ ID NO: 492 - DNA, 63 bp, Unknown
  encodes T2A self-cleaving peptide
ggatccggagagggcagaggcagcctgctgacatgtggcgacgtggaagagaaccctggcccc

SEQ ID NO: 493 - RNA, 943 nt, Homo sapiens
auuccugaagcugacagcauucgggccgagaugucucgcuccguggccuuagcugugcucgcgcuacucucucuuucuggccuggaggcuauccagcguacuccaaagauucagguuuacucacgucauccagcagagaauggaaagucaaauuuccugaauugcuaugugucuggguuucauccauccgacauugaaguugacuuacugaagaauggagagagaauugaaaaaguggagcauucagacuugucuuucagcaaggacuggucuuucuaucucuuguacuacacugaauucacccccacugaaaaagaugaguaugccugccgugugaaccaugugacuuugucacagcccaagauaguuaagugggaucgagacauguaagcagcaucauggagguuugaagaugccgcauuuggauuggaugaauuccaaauucugcuugcuugcuuuuuaauauugauaugcuuauacacuuacacuuuaugcacaaaauguaggguuauaauaauguuaacauggacaugaucuucuuuauaauucuacuuugagugcugucuccauguuugauguaucugagcagguugcuccacagguagcucuaggagggcuggcaacuuagagguggggagcagagaauucucuuauccaacaucaacaucuuggucagauuugaacucuucaaucucuugcacucaaagcuuguuaagauaguuaagcgugcauaaguuaacuuccaauuuacauacucugcuuagaauuugggggaaaauuuagaaauauaauugacaggauuauuggaaauuuguuauaaugaaugaaacauuuugucauauaagauucauauuuacuucuuauacauuugauaaaguaaggcaugguugugguuaaucugguuuauuuuuguuccacaaguuaaauaaaucauaaaacuuga

SEQ ID NO: 494 - DNA, 6654 bp, Homo sapiens
aagtggaggcgtcgcgctggcgggcattcctgaagctgacagcattcgggccgagatgtctcgctccgtggccttagctgtgctcgcgctactctctctttctggcctggaggctatccagcgtgagtctctcctaccctcccgctctggtccttcctctcccgctctgcaccctctgtggccctcgctgtgctctctcgctccgtgacttcccttctccaagttctccttggtggcccgccgtggggctagtccagggctggatctcggggaagcggcggggtggcctgggagtggggaagggggtgcgcacccgggacgcgcgctacttgcccctttcggcggggagcaggggagacctttggcctacggcgacgggagggtcgggacaaagtttagggcgtcgataagcgtcagagcgccgaggttgggggagggtttctcttccgctctttcgcggggcctctggctcccccagcgcagctggagtgggggacgggtaggctcgtcccaaaggcgcggcgctgaggtttgtgaacgcgtggaggggcgcttggggtctgggggaggcgtcgcccgggtaagcctgtctgctgcggctctgcttcccttagactggagagctgtggacttcgtctaggcgcccgctaagttcgcatgtcctagcacctctgggtctatgtggggccacaccgtggggaggaaacagcacgcgacgtttgtagaatgcttggctgtgatacaaagcggtttcgaataattaacttatttgttcccatcacatgtcacttttaaaaaattataagaactacccgttattgacatctttctgtgtgccaaggactttatgtgctttgcgtcatttaattttgaaaacagttatcttccgccatagataactactatggttatcttctgcctctcacagatgaagaaactaaggcaccgagattttaagaaacttaattacacaggggataaatggcagcaatcgagattgaagtcaagcctaaccagggcttttgcgggagcgcatgccttttggctgtaattcgtgcatttttttttaagaaaaacgcctgccttctgcgtgagattctccagagcaaactgggcggcatgggccctgtggtcttttcgtacagagggcttcctctttggctctttgcctggttgtttccaagatgtactgtgcctcttactttcggttttgaaaacatgagggggttgggcgtggtagcttacgcctgtaatcccagcacttagggaggccgaggcgggaggatggcttgaggtccgtagttgagaccagcctggccaacatggtgaagcctggtctctacaaaaaataataacaaaaattagccgggtgtggtggctcgtgcctgtggtcccagctgctccggtggctgaggcgggaggatctcttgagcttaggcttttgagctatcatggcgccagtgcactccagcgtgggcaacagagcgagaccctgtctctcaaaaaagaaaaaaaaaaaaaaagaaagagaaaagaaaagaaagaaagaagtgaaggtttgtcagtcaggggagctgtaaaaccattaataaagataatccaagatggttaccaagactgttgaggacgccagagatcttgagcactttctaagtacctggcaatacactaagcgcgctcaccttttcctctggcaaaacatgatcgaaagcagaatgttttgatcatgagaaaattgcatttaatttgaatacaatttatttacaacataaaggataatgtatatatcaccaccattactggtatttgctggttatgttagatgtcattttaaaaaataacaatctgatatttaaaaaaaaatcttattttgaaaatttccaaagtaatacatgccatgcatagaccatttctggaagataccacaagaaacatgtaatgatgattgcctctgaaggtctattttcctcctctgacctgtgtgtgggttttgtttttgttttactgtgggcataaattaatttttcagttaagttttggaagcttaaataactctccaaaagtcataaagccagtaactggttgagcccaaattcaaacccagcctgtctgatacttgtcctcttcttagaaaagattacagtgatgctctcacaaaatcttgccgccttccctcaaacagagagttccaggcaggatgaatctgtgctctgatccctgaggcatttaatatgttcttattattagaagctcagatgcaaagagctctcttagcttttaatgttatgaaaaaaatcaggtcttcattagattccccaatccacctcttgatggggctagtagcctttccttaatgatagggtgtttctagagagatatatctggtcaaggtggcctggtactcctccttctccccacagcctcccagacaaggaggagtagctgccttttagtgatcatgtaccctgaatataagtgtatttaaaagaattttatacacatatatttagtgtcaatctgtatatttagtagcactaacacttctcttcattttcaatgaaaaatatagagtttataatattttcttcccacttccccatggatggtctagtcatgcctctcattttggaaagtactgtttctgaaacattaggcaatatattcccaacctggctagtttacagcaatcacctgtggatgctaattaaaacgcaaatcccactgtcacatgcattactccatttgatcataatggaaagtatgttctgtcccatttgccatagtcctcacctatccctgttgtattttatcgggtccaactcaaccatttaaggtatttgccagctcttgtatgcatttaggttttgtttctttgttttttagctcatgaaattaggtacaaagtcagagaggggtctggcatataaaacctcagcagaaataaagaggttttgttgtttggtaagaacataccttgggttggttgggcacggtggctcgtgcctgtaatcccaacactttgggaggccaaggcaggctgatcacttgaagttgggagttcaagaccagcctggccaacatggtgaaatcccgtctctactgaaaatacaaaaattaaccaggcatggtggtgtgtgcctgtagtcccaggaatcacttgaacccaggaggcggaggttgcagtgagctgagatctcaccactgcacactgcactccagcctgggcaatggaatgagattccatcccaaaaaataaaaaaataaaaaaataaagaacataccttgggttgatccacttaggaacctcagataataacatctgccacgtatagagcaattgctatgtcccaggcactctactagacacttcatacagtttagaaaatcagatgggtgtagatcaaggcaggagcaggaaccaaaaagaaaggcataaacataagaaaaaaaatggaaggggtggaaacagagtacaataacatgagtaatttgatgggggctattatgaactgagaaatgaactttgaaaagtatcttggggccaaatcatgtagactcttgagtgatgtgttaaggaatgctatgagtgctgagagggcatcagaagtccttgagagcctccagagaaaggctcttaaaaatgcagcgcaatctccagtgacagaagatactgctagaaatctgctagaaaaaaaacaaaaaaggcatgtatagaggaattatgagggaaagataccaagtcacggtttattcttcaaaatggaggtggcttgttgggaaggtggaagctcatttggccagagtggaaatggaattgggagaaatcgatgaccaaatgtaaacacttggtgcctgatatagcttgacaccaagttagccccaagtgaaataccctggcaatattaatgtgtcttttcccgatattcctcaggtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtggggtaagtcttacattcttttgtaagctgctgaaagttgtgtatgagtagtcatatcataaagctgctttgatataaaaaaggtctatggccatactaccctgaatgagtcccatcccatctgatataaacaatctgcatattgggattgtcagggaatgttcttaaagatcagattagtggcacctgctgagatactgatgcacagcatggtttctgaaccagtagtttccctgcagttgagcagggagcagcagcagcacttgcacaaatacatatacactcttaacacttcttacctactggcttcctctagcttttgtggcagcttcaggtatatttagcactgaacgaacatctcaagaaggtataggcctttgtttgtaagtcctgctgtcctagcatcctataatcctggacttctccagtactttctggctggattggtatctgaggctagtaggaagggcttgttcctgctgggtagctctaaacaatgtattcatgggtaggaacagcagcctattctgccagccttatttctaaccattttagacatttgttagtacatggtattttaaaagtaaaacttaatgtcttccttttttttctccactgtctttttcatagatcgagacatgtaagcagcatcatggaggtaagtttttgaccttgagaaaatgtttttgtttcactgtcctgaggactatttatagacagctctaacatgataaccctcactatgtggagaacattgacagagtaacattttagcagggaaagaagaatcctacagggtcatgttcccttctcctgtggagtggcatgaagaaggtgtatggccccaggtatggccatattactgaccctctacagagagggcaaaggaactgccagtatggtattgcaggataaaggcaggtggttacccacattacctgcaaggctttgatctttcttctgccatttccacattggacatctctgctgaggagagaaaatgaaccactcttttcctttgtataatgttgttttattcttcagacagaagagaggagttatacagctctgcagacatcccattcctgtatggggactgtgtttgcctcttagaggttcccaggccactagaggagataaagggaaacagattgttataacttgatataatgatactataatagatgtaactacaaggagctccagaagcaagagagagggaggaacttggacttctctgcatctttagttggagtccaaaggcttttcaatgaaattctactgcccagggtacattgatgctgaaaccccattcaaatctcctgttatattctagaacagggaattgatttgggagagcatcaggaaggtggatgatctgcccagtcacactgttagtaaattgtagagccaggacctgaactctaatatagtcatgtgttacttaatgacggggacatgttctgagaaatgcttacacaaacctaggtgttgtagcctactacacgcataggctacatggtatagcctattgctcctagactacaaacctgtacagcctgttactgtactgaatactgtgggcagttgtaacacaatggtaagtatttgtgtatctaaacatagaagttgcagtaaaaatatgctattttaatcttatgagaccactgtcatatatacagtccatcattgaccaaaacatcatatcagcattttttcttctaagattttgggagcaccaaagggatacactaacaggatatactctttataatgggtttggagaactgtctgcagctacttcttttaaaaaggtgatctacacagtagaaattagacaagtttggtaatgagatctgcaatccaaataaaataaattcattgctaacctttttcttttcttttcaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaagttaaataaatcataaaacttga

SEQ ID NO: 495 - DNA, 1698 bp, Artificial Sequence
  HLA-A*02:01:01:01 sequence encoding mRNA
cagaagcagaggggtcagggcgaagtcccagggccccaggcgtggctctcagggtctcaggccccgaaggcggtgtatggattggggagtcccagccttggggattccccaactccgcagtttcttttctccctctcccaacctatgtagggtccttcttcctggatactcacgacgcggacccagttctcactcccattgggtgtcgggtttccagagaagccaatcagtgtcgtcgcggtcgcggttctaaagtccgcacgcacccaccgggactcagattctccccagacgccgaggatggccgtcatggcgccccgaaccctcgtcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggagccgtcttcccagcccaccatccccatcgtgggcatcattgctggcctggttctctttggagctgtgatcactggagctgtggtcgctgctgtgatgtggaggaggaagagctcagatagaaaaggagggagctactctcaggctgcaagcagtgacagtgcccagggctctgatgtgtctctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaa

SEQ ID NO: 496 - DNA, 3217 bp, Homo sapiens
atggccgtcatggcgccccgaaccctcgtcctgctactctcgggggctctggccctgacccagacctgggcgggtgagtgcggggtcgggagggaaacggcctctgtggggagaagcaacgggcccgcctggcgggggcgcaggacccgggaagccgcgccgggaggagggtcgggcgggtctcagccactcctcgtccccaggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggtgagtgaccccggcccggggcgcaggtcacgacctctcatcccccacggacgggccaggtcgcccacagtctccgggtccgagatccgccccgaagccgcgggaccccgagacccttgccccgggagaggcccaggcgcctttacccggtttcattttcagtttaggccaaaaatccccccaggttggtcggggcggggcggggctcgggggaccgggctgaccgcggggtccgggccaggttctcacaccgtccagaggatgtatggctgcgacgtggggtcggactggcgcttcctccgcgggtaccaccagtacgcctacgacggcaaggattacatcgccctgaaagaggacctgcgctctttgaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacgggtaccaggggccacggggcgcctccctgatcgcctgtagatctcccgggctggcctcccacaaggaggggagacaattgggaccaacactagaatatcgccctccctctggtcctgagggagaggaatcctcctgggtttccagatcctgtaccagagagtgactctgaggttccgccctgctctctgacacaattaagggataaaatctctgaaggaatgacgggaagacgatccctcgaatactgatgagtggttccctttgacacacacaggcagcagccttgggcccgtgacttttcctctcaggccttgttctctgcttcacactcaatgtgtgtgggggtctgagtccagcacttctgagtccttcagcctccactcaggtcaggaccagaagtcgctgttccctcttcagggactagaattttccacggaataggagattatcccaggtgcctgtgtccaggctggtgtctgggttctgtgctcccttccccatcccaggtgtcctgtccattctcaagatagccacatgtgtgctggaggagtgtcccatgacagatgcaaaatgcctgaatgatctgactcttcctgacagacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatggggtaaggagggagacgggggtgtcatgtcttttagggaaagcaggagcctctctgacctttagcagggtcagggcccctcaccttcccctcttttcccagagccgtcttcccagcccaccatccccatcgtgggcatcattgctggcctggttctctttggagctgtgatcactggagctgtggtcgctgctgtgatgtggaggaggaagagctcaggtggggaaggggtgaagggtgggtctgagatttcttgtctcactgagggttccaagacccaggtagaagtgtgccctgcctcgttactgggaagcaccacccacaattatgggcctacccagcctgggccctgtgtgccagcacttactcttttgtaaagcacctgttaaaatgaaggacagatttatcaccttgattacagcggtgatgggacctgatcccagcagtcacaagtcacaggggaaggtccctgaggaccttcaggagggcggttggtccaggacccacacctgctttcttcatgtttcctgatcccgccctgggtctgcagtcacacatttctggaaacttctctgaggtccaagacttggaggttcctctaggaccttaaggccctgactcctttctggtatctcacaggacattttcttcccacagatagaaaaggagggagctactctcaggctgcaagtaagtatgaaggaggctgatgcctgaggtccttgggatattgtgtttgggagcccatgggggagctcacccaccccacaattcctcctctagccacatcttctgtgggatctgaccaggttctgtttttgttctaccccaggcagtgacagtgcccagggctctgatgtgtctctcacagcttgtaaaggtgagagcctggagggcctgatgtgtgttgggtgttgggcggaacagtggacacagctgtgctatggggtttctttccattggatgtattgagcatgcgatgggctgtttaaagtgtgacccctcactgtgacagatacgaatttgttcatgaatatttttttctatagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaa

SEQ ID NO: 497 - DNA, 83 bp, Unknown
  encodes scaffold sequence
gttttagagctagaaatagcaagttaaaataaggctagtccgttatcaacttgaaaaagtggcaccgagtcggtgcttttttt

SEQ ID NO: 498 - DNA, 20 bp, Artificial Sequence
  Guide Nucleic Acid Targeting Sequence
tggacgacacgcagttcgtg

SEQ ID NO: 499 - DNA, 20 bp, Artificial Sequence
  Guide Nucleic Acid Targeting Sequence
cagatacctggagaacggga

SEQ ID NO: 500 - DNA, 20 bp, Artificial Sequence
  Guide Nucleic Acid Targeting Sequence
tcccgttctccaggtatctg

SEQ ID NO: 501 - DNA, 20 bp, Artificial Sequence
  Guide Nucleic Acid Targeting Sequence
ccgccgcggtccaagagcgc

SEQ ID NO: 502 - DNA, 20 bp, Artificial Sequence
  Guide Nucleic Acid Targeting Sequence
cctgcgctcttggaccgcgg

SEQ ID NO: 503 - DNA, 21 bp, Artificial Sequence
  Guide Nucleic Acid Targeting Sequence
ggacctgcgctcttggaccgc

SEQ ID NO: 504 - DNA, 23 bp, Artificial Sequence
  Guide Nucleic Acid Targeting Sequence
aaggagacgctgcagcgcacggg

SEQ ID NO: 505 - DNA, 23 bp, Artificial Sequence
  Guide Nucleic Acid Targeting Sequence
gaaggagacgctgcagcgcacgg

SEQ ID NO: 506 - DNA, 23 bp, Artificial Sequence
  Guide Nucleic Acid Targeting Sequence
gcgggcgccgtggatagagcagg

SEQ ID NO: 507 - DNA, 23 bp, Artificial Sequence
  Guide Nucleic Acid Targeting Sequence
tgctctatccacggcgcccgcgg

SEQ ID NO: 508 - DNA, 23 bp, Artificial Sequence
  Guide Nucleic Acid Targeting Sequence
cgatgaagcggggctccccgcgg

SEQ ID NO: 509 - DNA, 23 bp, Artificial Sequence
  Guide Nucleic Acid Targeting Sequence
cgtgtcccggcccggccgcgggg

SEQ ID NO: 510 - DNA, 23 bp, Artificial Sequence
  Guide Nucleic Acid Targeting Sequence
cggctccatcctctggctcgcgg

SEQ ID NO: 511 - DNA, 23 bp, Artificial Sequence
  Guide Nucleic Acid Targeting Sequence
gatgtaatccttgccgtcgtagg

SEQ ID NO: 512 - DNA, 23 bp, Artificial Sequence
  Guide Nucleic Acid Targeting Sequence
acagcgacgccgcgagccagagg

SEQ ID NO: 513 - DNA, 23 bp, Artificial Sequence
  Guide Nucleic Acid Targeting Sequence
ggatggagccgcgggcgccgtgg

SEQ ID NO: 514 - DNA, 23 bp, Artificial Sequence
  Guide Nucleic Acid Targeting Sequence
ggcgccgtggatagagcaggagg

SEQ ID NO: 515 - DNA, 23 bp, Artificial Sequence
  Guide Nucleic Acid Targeting Sequence
gcgccgtggatagagcaggaggg

SEQ ID NO: 516 - DNA, 23 bp, Artificial Sequence
  Guide Nucleic Acid Targeting Sequence
cggctactacaaccagagcgagg

SEQ ID NO: 517 - DNA, 23 bp, Artificial Sequence
  Guide Nucleic Acid Targeting Sequence
ctggttgtagtagccgcgcaggg

SEQ ID NO: 518 - DNA, 23 bp, Artificial Sequence
  Guide Nucleic Acid Targeting Sequence
tactacaaccagagcgaggccgg

SEQ ID NO: 519 - DNA, 23 bp, Artificial Sequence
  Guide Nucleic Acid Targeting Sequence
ctacctggagggcacgtgcgtgg

SEQ ID NO: 520 - DNA, 23 bp, Artificial Sequence
  Guide Nucleic Acid Targeting Sequence
cacgcacgtgccctccaggtagg

SEQ ID NO: 521 - DNA, 23 bp, Artificial Sequence
  Guide Nucleic Acid Targeting Sequence
gcagggtccccaggtccactcgg

SEQ ID NO: 522 - DNA, 23 bp, Artificial Sequence
  Guide Nucleic Acid Targeting Sequence
gtggacctggggaccctgcgcgg

SEQ ID NO: 523 - DNA, 23 bp, Artificial Sequence
  Guide Nucleic Acid Targeting Sequence
tggagggcacgtgcgtggagtgg

SEQ ID NO: 524 - DNA, 23 bp, Artificial Sequence
  Guide Nucleic Acid Targeting Sequence
gtatggctgcgacgtggggtcgg

SEQ ID NO: 525 - DNA, 23 bp, Artificial Sequence
  Guide Nucleic Acid Targeting Sequence
ctgagctgccatgtccgccgcgg

SEQ ID NO: 526 - DNA, 23 bp, Artificial Sequence
  Guide Nucleic Acid Targeting Sequence
ggattacatcgccctgaaagagg

SEQ ID NO: 527 - DNA, 23 bp, Artificial Sequence
  Guide Nucleic Acid Targeting Sequence
caagtgggaggcggcccatgtgg

SEQ ID NO: 528 - DNA, 23 bp, Artificial Sequence
  Guide Nucleic Acid Targeting Sequence
gtgggaggcggcccatgtggcgg

SEQ ID NO: 529 - DNA, 23 bp, Artificial Sequence
  Guide Nucleic Acid Targeting Sequence
cagttgagagcctacctggaggg

SEQ ID NO: 530 - DNA, 23 bp, Artificial Sequence
  Guide Nucleic Acid Targeting Sequence
gcagttgagagcctacctggagg

SEQ ID NO: 531 - DNA, 23 bp, Artificial Sequence
  Guide Nucleic Acid Targeting Sequence
taccaccagtacgcctacgacgg

SEQ ID NO: 532 - DNA, 23 bp, Artificial Sequence
  Guide Nucleic Acid Targeting Sequence
tgccgtcgtaggcgtactggtgg

SEQ ID NO: 533 - DNA, 23 bp, Artificial Sequence
  Guide Nucleic Acid Targeting Sequence
ccagtacgcctacgacggcaagg

SEQ ID NO: 534 - DNA, 23 bp, Artificial Sequence
  Guide Nucleic Acid Targeting Sequence
ggatgtgaagaaatacctcatgg

SEQ ID NO: 535 - DNA, 23 bp, Artificial Sequence
  Guide Nucleic Acid Targeting Sequence
atttcttcacatccgtgtcccgg

SEQ ID NO: 536 - DNA, 23 bp, Artificial Sequence
  Guide Nucleic Acid Targeting Sequence
aggcgtactggtggtacccgcgg

SEQ ID NO: 537 - DNA, 23 bp, Artificial Sequence
  Guide Nucleic Acid Targeting Sequence
cgtactggtggtacccgcggagg

SEQ ID NO: 538 - DNA, 23 bp, Artificial Sequence
  Guide Nucleic Acid Targeting Sequence
gaggatgtatggctgcgacgtgg

SEQ ID NO: 539 - DNA, 23 bp, Artificial Sequence
  Guide Nucleic Acid Targeting Sequence
ggatgtatggctgcgacgtgggg

SEQ ID NO: 540 - DNA, 23 bp, Artificial Sequence
  Guide Nucleic Acid Targeting Sequence
ctcagaccaccaagcacaagtgg

SEQ ID NO: 541 - DNA, 23 bp, Artificial Sequence
  Guide Nucleic Acid Targeting Sequence
tcagaccaccaagcacaagtggg

SEQ ID NO: 542 - DNA, 23 bp, Artificial Sequence
  Guide Nucleic Acid Targeting Sequence
caccaagcacaagtgggaggcgg

SEQ ID NO: 543 - DNA, 23 bp, Artificial Sequence
  Guide Nucleic Acid Targeting Sequence
gaccaccaagcacaagtgggagg

SEQ ID NO: 544 - DNA, 23 bp, Artificial Sequence
  Guide Nucleic Acid Targeting Sequence
gagccccgcttcatcgcagtggg

SEQ ID NO: 545 - DNA, 23 bp, Artificial Sequence
  Guide Nucleic Acid Targeting Sequence
gtagcccactgcgatgaagcggg

SEQ ID NO: 546 - DNA, 23 bp, Artificial Sequence
  Guide Nucleic Acid Targeting Sequence
tagcccactgcgatgaagcgggg

SEQ ID NO: 547 - DNA, 23 bp, Artificial Sequence
  Guide Nucleic Acid Targeting Sequence
cgtagcccactgcgatgaagcgg

SEQ ID NO: 548 - DNA, 23 bp, Artificial Sequence
  Guide Nucleic Acid Targeting Sequence
cttcatcgcagtgggctacgtgg

SEQ ID NO: 549 - DNA, 23 bp, Artificial Sequence
  Guide Nucleic Acid Targeting Sequence
ggagccccgcttcatcgcagtgg

SEQ ID NO: 550 - DNA, 23 bp, Artificial Sequence
  Guide Nucleic Acid Targeting Sequence
cggggagacacggaaagtgaagg

SEQ ID NO: 551 - DNA, 23 bp, Artificial Sequence
  Guide Nucleic Acid Targeting Sequence
agtattgggacggggagacacgg

SEQ ID NO: 552 - DNA, 23 bp, Artificial Sequence
  Guide Nucleic Acid Targeting Sequence
agggtccggagtattgggacggg

SEQ ID NO: 553 - DNA, 23 bp, Artificial Sequence
  Guide Nucleic Acid Targeting Sequence
gagggtccggagtattgggacgg

SEQ ID NO: 554 - DNA, 23 bp, Artificial Sequence
  Guide Nucleic Acid Targeting Sequence
ggaccctcctgctctatccacgg

SEQ ID NO: 555 - DNA, 23 bp, Artificial Sequence
  Guide Nucleic Acid Targeting Sequence
gtggatagagcaggagggtccgg

SEQ ID NO: 556 - DNA, 23 bp, Artificial Sequence
  Guide Nucleic Acid Targeting Sequence
agactcaccgagtggacctgggg

SEQ ID NO: 557 - DNA, 23 bp, Artificial Sequence
  Guide Nucleic Acid Targeting Sequence
cactcggtgagtctgtgagtggg

SEQ ID NO: 558 - DNA, 23 bp, Artificial Sequence
  Guide Nucleic Acid Targeting Sequence
cagactcaccgagtggacctggg

SEQ ID NO: 559 - DNA, 23 bp, Artificial Sequence
  Guide Nucleic Acid Targeting Sequence
ccactcacagactcaccgagtgg

SEQ ID NO: 560 - DNA, 23 bp, Artificial Sequence
  Guide Nucleic Acid Targeting Sequence
ccactcggtgagtctgtgagtgg

SEQ ID NO: 561 - DNA, 23 bp, Artificial Sequence
  Guide Nucleic Acid Targeting Sequence
tcggactggcgcttcctccgcgg

SEQ ID NO: 562 - DNA, 23 bp, Artificial Sequence
  Guide Nucleic Acid Targeting Sequence
gcagccatacatcctctggacgg

SEQ ID NO: 563 - DNA, 23 bp, Artificial Sequence
  Guide Nucleic Acid Targeting Sequence
tctcaactgctccgccacatggg

SEQ ID NO: 564 - DNA, 23 bp, Artificial Sequence
  Guide Nucleic Acid Targeting Sequence
accctcatgctgcacatggcagg

SEQ ID NO: 565 - DNA, 23 bp, Artificial Sequence
  Guide Nucleic Acid Targeting Sequence
acctgccatgtgcagcatgaggg

SEQ ID NO: 566 - DNA, 23 bp, Artificial Sequence
  Guide Nucleic Acid Targeting Sequence
cacctgccatgtgcagcatgagg

SEQ ID NO: 567 - DNA, 23 bp, Artificial Sequence
  Guide Nucleic Acid Targeting Sequence
ggaggaccagacccaggacacgg

SEQ ID NO: 568 - DNA, 23 bp, Artificial Sequence
  Guide Nucleic Acid Targeting Sequence
ggatggggaggaccagacccagg

SEQ ID NO: 569 - DNA, 23 bp, Artificial Sequence
  Guide Nucleic Acid Targeting Sequence
gacctggcagcgggatggggagg

SEQ ID NO: 570 - DNA, 23 bp, Artificial Sequence
  Guide Nucleic Acid Targeting Sequence
agatcacactgacctggcagcgg

SEQ ID NO: 571 - DNA, 23 bp, Artificial Sequence
  Guide Nucleic Acid Targeting Sequence
gatcacactgacctggcagcggg

SEQ ID NO: 572 - DNA, 23 bp, Artificial Sequence
  Guide Nucleic Acid Targeting Sequence
aggtcagtgtgatctccgcaggg

SEQ ID NO: 573 - DNA, 23 bp, Artificial Sequence
  Guide Nucleic Acid Targeting Sequence
aagcccctcaccctgagatgggg

SEQ ID NO: 574 - DNA, 23 bp, Artificial Sequence
  Guide Nucleic Acid Targeting Sequence
ctgcggagatcacactgacctgg

SEQ ID NO: 575 - DNA, 23 bp, Artificial Sequence
  Guide Nucleic Acid Targeting Sequence
cagcaatgatgcccacgatgggg

SEQ ID NO: 576 - DNA, 23 bp, Artificial Sequence
  Guide Nucleic Acid Targeting Sequence
ccagcaatgatgcccacgatggg

SEQ ID NO: 577 - DNA, 23 bp, Artificial Sequence
  Guide Nucleic Acid Targeting Sequence
gccagcaatgatgcccacgatgg

SEQ ID NO: 578 - DNA, 23 bp, Artificial Sequence
  Guide Nucleic Acid Targeting Sequence
ggatggaaccttccagaagtggg

SEQ ID NO: 579 - DNA, 23 bp, Artificial Sequence
  Guide Nucleic Acid Targeting Sequence
gggatggaaccttccagaagtgg

SEQ ID NO: 580 - DNA, 23 bp, Artificial Sequence
  Guide Nucleic Acid Targeting Sequence
atgcccacgatggggatggtggg

SEQ ID NO: 581 - DNA, 23 bp, Artificial Sequence
  Guide Nucleic Acid Targeting Sequence
cagcccaccatccccatcgtggg

SEQ ID NO: 582 - DNA, 23 bp, Artificial Sequence
  Guide Nucleic Acid Targeting Sequence
ccagcccaccatccccatcgtgg

SEQ ID NO: 583 - DNA, 23 bp, Artificial Sequence
  Guide Nucleic Acid Targeting Sequence
gatgcccacgatggggatggtgg

SEQ ID NO: 584 - DNA, 23 bp, Artificial Sequence
  Guide Nucleic Acid Targeting Sequence
cagggcccagcacctcagggtgg

SEQ ID NO: 585 - DNA, 23 bp, Artificial Sequence
  Guide Nucleic Acid Targeting Sequence
aatgatgcccacgatggggatgg

SEQ ID NO: 586 - DNA, 23 bp, Artificial Sequence
  Guide Nucleic Acid Targeting Sequence
ggccctgacccagacctgggcgg

SEQ ID NO: 587 - DNA, 23 bp, Artificial Sequence
  Guide Nucleic Acid Targeting Sequence
gacccaggacacggagctcgtgg

SEQ ID NO: 588 - DNA, 23 bp, Artificial Sequence
  Guide Nucleic Acid Targeting Sequence
acacggagctcgtggagaccagg

SEQ ID NO: 589 - DNA, 23 bp, Artificial Sequence
  Guide Nucleic Acid Targeting Sequence
cgtggagaccaggcctgcagggg

SEQ ID NO: 590 - DNA, 23 bp, Artificial Sequence
  Guide Nucleic Acid Targeting Sequence
tcgtggagaccaggcctgcaggg

SEQ ID NO: 591 - DNA, 23 bp, Artificial Sequence
  Guide Nucleic Acid Targeting Sequence
agctgtgatcactggagctgtgg

SEQ ID NO: 592 - DNA, 23 bp, Artificial Sequence
  Guide Nucleic Acid Targeting Sequence
aaaaggagggagctactctcagg

SEQ ID NO: 593 - DNA, 23 bp, Artificial Sequence
  Guide Nucleic Acid Targeting Sequence
atgtggaggaggaagagctcagg

SEQ ID NO: 594 - DNA, 23 bp, Artificial Sequence
  Guide Nucleic Acid Targeting Sequence
gtgtctctcacagcttgtaaagg

SEQ ID NO: 595 - DNA, 23 bp, Artificial Sequence
  Guide Nucleic Acid Targeting Sequence
gagagacacatcagagccctggg

SEQ ID NO: 596 - DNA, 23 bp, Artificial Sequence
  Guide Nucleic Acid Targeting Sequence
ctccgcagggtagaagctcaggg

SEQ ID NO: 597 - DNA, 23 bp, Artificial Sequence
  Guide Nucleic Acid Targeting Sequence
ggccctgagcttctaccctgcgg

SEQ ID NO: 598 - DNA, 23 bp, Artificial Sequence
  Guide Nucleic Acid Targeting Sequence
gctcagggcccagcacctcaggg

SEQ ID NO: 599 - DNA, 23 bp, Artificial Sequence
  Guide Nucleic Acid Targeting Sequence
tatctctgctcctgtccagaagg

SEQ ID NO: 600 - DNA, 23 bp, Artificial Sequence
  Guide Nucleic Acid Targeting Sequence
agtagcaggacgagggttcgggg

SEQ ID NO: 601 - DNA, 23 bp, Artificial Sequence
  Guide Nucleic Acid Targeting Sequence
ccccgagagtagcaggacgaggg

SEQ ID NO: 602 - DNA, 23 bp, Artificial Sequence
  Guide Nucleic Acid Targeting Sequence
ccctcgtcctgctactctcgggg

SEQ ID NO: 603 - DNA, 23 bp, Artificial Sequence
  Guide Nucleic Acid Targeting Sequence
cctcgtcctgctactctcggggg

SEQ ID NO: 604 - DNA, 23 bp, Artificial Sequence
  Guide Nucleic Acid Targeting Sequence
ctgtggtcgctgctgtgatgtgg

SEQ ID NO: 605 - DNA, 23 bp, Artificial Sequence
  Guide Nucleic Acid Targeting Sequence
tcgctgctgtgatgtggaggagg

SEQ ID NO: 606 - DNA, 23 bp, Artificial Sequence
  Guide Nucleic Acid Targeting Sequence
tggtcgctgctgtgatgtggagg

SEQ ID NO: 607 - DNA, 23 bp, Artificial Sequence
  Guide Nucleic Acid Targeting Sequence
cacagccgcccacttctggaagg

SEQ ID NO: 608 - DNA, 23 bp, Artificial Sequence
  Guide Nucleic Acid Targeting Sequence
ccagaagtgggcggctgtggtgg

SEQ ID NO: 609 - DNA, 23 bp, Artificial Sequence
  Guide Nucleic Acid Targeting Sequence
tggaaccttccagaagtgggcgg

SEQ ID NO: 610 - DNA, 23 bp, Artificial Sequence
  Guide Nucleic Acid Targeting Sequence
tcacagctccaaagagaaccagg

SEQ ID NO: 611 - DNA, 23 bp, Artificial Sequence
  Guide Nucleic Acid Targeting Sequence
ctgaccatgaagccaccctgagg

SEQ ID NO: 612 - DNA, 23 bp, Artificial Sequence
  Guide Nucleic Acid Targeting Sequence
gcaaaccctcatgctgcacatgg

SEQ ID NO: 613 - DNA, 23 bp, Artificial Sequence
  Guide Nucleic Acid Targeting Sequence
tgaagccaccctgaggtgctggg

SEQ ID NO: 614 - DNA, 23 bp, Artificial Sequence
  Guide Nucleic Acid Targeting Sequence
ggtgagtcatatgcgttttgggg

SEQ ID NO: 615 - DNA, 23 bp, Artificial Sequence
  Guide Nucleic Acid Targeting Sequence
gtgagtcatatgcgttttggggg

SEQ ID NO: 616 - DNA, 23 bp, Artificial Sequence
  Guide Nucleic Acid Targeting Sequence
cttcatggtcagagacagcgtgg

SEQ ID NO: 617 - DNA, 23 bp, Artificial Sequence
  Guide Nucleic Acid Targeting Sequence
tctggccctgacccagacctggg

SEQ ID NO: 618 - DNA, 20 bp, Artificial Sequence
  sequence targeting B2M
cgcgagcacagctaaggcca

SEQ ID NO: 619 - DNA, 20 bp, Artificial Sequence
  sequence targeting B2M
gagtagcgcgagcacagcta

SEQ ID NO: 620 - DNA, 20 bp, Artificial Sequence
  sequence targeting B2M
agggtaggagagactcacgc

SEQ ID NO: 621 - DNA, 20 bp, Artificial Sequence
  sequence targeting B2M
ctgaatctttggagtacctg

SEQ ID NO: 622 - DNA, 20 bp, Artificial Sequence
  sequence targeting B2M
tcacgtcatccagcagagaa

SEQ ID NO: 623 - DNA, 20 bp, Artificial Sequence
  sequence targeting B2M
tcctgaattgctatgtgtct

SEQ ID NO: 624 - DNA, 20 bp, Artificial Sequence
  sequence targeting B2M
aagtcaacttcaatgtcgga

SEQ ID NO: 625 - DNA, 20 bp, Artificial Sequence
  sequence targeting B2M
gtcttttcccgatattcctc

SEQ ID NO: 626 - DNA, 20 bp, Artificial Sequence
  sequence targeting B2M
tggagtacctgaggaatatc

SEQ ID NO: 627 - DNA, 20 bp, Artificial Sequence
  sequence targeting B2M
cagcccaagatagttaagtg

SEQ ID NO: 628 - DNA, 20 bp, Artificial Sequence
  sequence targeting B2M
acaaagtcacatggttcaca

SEQ ID NO: 629 - DNA, 20 bp, Artificial Sequence
  sequence targeting B2M
actctctctttctggcctgg

SEQ ID NO: 630 - DNA, 20 bp, Artificial Sequence
  sequence targeting B2M
tgggctgtgacaaagtcaca

SEQ ID NO: 631 - DNA, 20 bp, Artificial Sequence
  sequence targeting B2M
ggccgagatgtctcgctccg

SEQ ID NO: 632 - DNA, 20 bp, Artificial Sequence
  sequence targeting B2M
cagtaagtcaacttcaatgt

SEQ ID NO: 633 - DNA, 20 bp, Artificial Sequence
  sequence targeting B2M
actcacgctggatagcctcc

SEQ ID NO: 634 - DNA, 20 bp, Artificial Sequence
  sequence targeting B2M
catactcatctttttcagtg

SEQ ID NO: 635 - DNA, 20 bp, Artificial Sequence
  sequence targeting B2M
cacagcccaagatagttaag

SEQ ID NO: 636 - DNA, 20 bp, Artificial Sequence
  sequence targeting B2M
ttcagacttgtctttcagca

SEQ ID NO: 637 - DNA, 20 bp, Artificial Sequence
  sequence targeting B2M
agtcacatggttcacacggc

SEQ ID NO: 638 - DNA, 20 bp, Artificial Sequence
  sequence targeting B2M
atactcatctttttcagtgg

SEQ ID NO: 639 - DNA, 20 bp, Artificial Sequence
  sequence targeting B2M
ggcatactcatctttttcag

SEQ ID NO: 640 - DNA, 20 bp, Artificial Sequence
  sequence targeting B2M
acagcccaagatagttaagt

SEQ ID NO: 641 - DNA, 20 bp, Artificial Sequence
  sequence targeting B2M
gctactctctctttctggcc

SEQ ID NO: 642 - DNA, 20 bp, Artificial Sequence
  sequence targeting B2M
tggagagagaattgaaaaag

SEQ ID NO: 643 - DNA, 20 bp, Artificial Sequence
  sequence targeting B2M
acttgtctttcagcaaggac

SEQ ID NO: 644 - DNA, 20 bp, Artificial Sequence
  sequence targeting B2M
gaagttgacttactgaagaa

SEQ ID NO: 645 - DNA, 20 bp, Artificial Sequence
  sequence targeting B2M
ggccacggagcgagacatct

SEQ ID NO: 646 - DNA, 20 bp, Artificial Sequence
  sequence targeting B2M
gcatactcatctttttcagt

SEQ ID NO: 647 - DNA, 20 bp, Artificial Sequence
  sequence targeting B2M
cgtgagtaaacctgaatctt

SEQ ID NO: 648 - DNA, 20 bp, Artificial Sequence
  sequence targeting B2M
ttaccccacttaactatctt

SEQ ID NO: 649 - DNA, 20 bp, Artificial Sequence
  sequence targeting B2M
ttggagtacctgaggaatat

SEQ ID NO: 650 - DNA, 20 bp, Artificial Sequence
  sequence targeting B2M
acccagacacatagcaattc

SEQ ID NO: 651 - DNA, 20 bp, Artificial Sequence
  sequence targeting B2M
tttgactttccattctctgc

SEQ ID NO: 652 - DNA, 20 bp, Artificial Sequence
  sequence targeting B2M
ttcctgaattgctatgtgtc

SEQ ID NO: 653 - DNA, 20 bp, Artificial Sequence
  sequence targeting B2M
ctcaggtactccaaagattc

SEQ ID NO: 654 - DNA, 20 bp, Artificial Sequence
  sequence targeting B2M
cttaccccacttaactatct

SEQ ID NO: 655 - DNA, 20 bp, Artificial Sequence
  sequence targeting B2M
ctcgcgctactctctctttc

SEQ ID NO: 656 - DNA, 20 bp, Artificial Sequence
  sequence targeting B2M
tcgatctatgaaaaagacag

SEQ ID NO: 657 - DNA, 20 bp, Artificial Sequence
  sequence targeting B2M
gagacatgtaagcagcatca

SEQ ID NO: 658 - DNA, 20 bp, Artificial Sequence
  sequence targeting B2M
acatgtaagcagcatcatgg

SEQ ID NO: 659 - DNA, 20 bp, Artificial Sequence
  sequence targeting B2M
gaagtcctagaatgagcgcc

SEQ ID NO: 660 - DNA, 20 bp, Artificial Sequence
  sequence targeting B2M
gagcgcccggtgtcccaagc

SEQ ID NO: 661 - DNA, 20 bp, Artificial Sequence
  sequence targeting B2M
agcgcccggtgtcccaagct

SEQ ID NO: 662 - DNA, 20 bp, Artificial Sequence
  sequence targeting B2M
gcgcccggtgtcccaagctg

SEQ ID NO: 663 - DNA, 20 bp, Artificial Sequence
  sequence targeting B2M
ctggggcgcgcaccccagat

SEQ ID NO: 664 - DNA, 20 bp, Artificial Sequence
  sequence targeting B2M
gggcgcgcaccccagatcgg

SEQ ID NO: 665 - DNA, 20 bp, Artificial Sequence
  sequence targeting B2M
ggcgcgcaccccagatcgga

SEQ ID NO: 666 - DNA, 20 bp, Artificial Sequence
  sequence targeting B2M
catcacgagactctaagaaa

SEQ ID NO: 667 - DNA, 20 bp, Artificial Sequence
  sequence targeting B2M
taagaaaaggaaactgaaaa

SEQ ID NO: 668 - DNA, 20 bp, Artificial Sequence
  sequence targeting B2M
aagaaaaggaaactgaaaac

SEQ ID NO: 669 - DNA, 20 bp, Artificial Sequence
  sequence targeting B2M
gaaagtccctctctctaacc

SEQ ID NO: 670 - DNA, 20 bp, Artificial Sequence
  sequence targeting B2M
ctaacctggcactgcgtcgc

SEQ ID NO: 671 - DNA, 20 bp, Artificial Sequence
  sequence targeting B2M
ctggcactgcgtcgctggct

SEQ ID NO: 672 - DNA, 20 bp, Artificial Sequence
  sequence targeting B2M
tgcgtcgctggcttggagac

SEQ ID NO: 673 - DNA, 20 bp, Artificial Sequence
  sequence targeting B2M
gctggcttggagacaggtga

SEQ ID NO: 674 - DNA, 20 bp, Artificial Sequence
  sequence targeting B2M
gagacaggtgacggtccctg

SEQ ID NO: 675 - DNA, 20 bp, Artificial Sequence
  sequence targeting B2M
agacaggtgacggtccctgc

SEQ ID NO: 676 - DNA, 20 bp, Artificial Sequence
  sequence targeting B2M
cctgcgggccttgtcctgat

SEQ ID NO: 677 - DNA, 20 bp, Artificial Sequence
  sequence targeting B2M
cgggccttgtcctgattggc

SEQ ID NO: 678 - DNA, 20 bp, Artificial Sequence
  sequence targeting B2M
gggccttgtcctgattggct

SEQ ID NO: 679 - DNA, 20 bp, Artificial Sequence
  sequence targeting B2M
gggcacgcgtttaatataag

SEQ ID NO: 680 - DNA, 20 bp, Artificial Sequence
  sequence targeting B2M
cacgcgtttaatataagtgg

SEQ ID NO: 681 - DNA, 20 bp, Artificial Sequence
  sequence targeting B2M
tataagtggaggcgtcgcgc

SEQ ID NO: 682 - DNA, 20 bp, Artificial Sequence
  sequence targeting B2M
aagtggaggcgtcgcgctgg

SEQ ID NO: 683 - DNA, 20 bp, Artificial Sequence
  sequence targeting B2M
agtggaggcgtcgcgctggc

SEQ ID NO: 684 - DNA, 20 bp, Artificial Sequence
  sequence targeting B2M
ttcctgaagctgacagcatt

SEQ ID NO: 685 - DNA, 20 bp, Artificial Sequence
  sequence targeting B2M
tcctgaagctgacagcattc

SEQ ID NO: 686 - DNA, 20 bp, Artificial Sequence
  sequence targeting B2M
gcccgaatgctgtcagcttc

SEQ ID NO: 687 - DNA, 20 bp, Artificial Sequence
  sequence targeting B2M
aaacgcgtgcccagccaatc

SEQ ID NO: 688 - DNA, 20 bp, Artificial Sequence
  sequence targeting B2M
gtgcccagccaatcaggaca

SEQ ID NO: 689 - DNA, 20 bp, Artificial Sequence
  sequence targeting B2M
ccaatcaggacaaggcccgc

SEQ ID NO: 690 - DNA, 20 bp, Artificial Sequence
  sequence targeting B2M
caatcaggacaaggcccgca

SEQ ID NO: 691 - DNA, 20 bp, Artificial Sequence
  sequence targeting B2M
caagccagcgacgcagtgcc

SEQ ID NO: 692 - DNA, 20 bp, Artificial Sequence
  sequence targeting B2M
cgcagtgccaggttagagag

SEQ ID NO: 693 - DNA, 20 bp, Artificial Sequence
  sequence targeting B2M
gcagtgccaggttagagaga

SEQ ID NO: 694 - DNA, 20 bp, Artificial Sequence
  sequence targeting B2M
gagtctcgtgatgtttaaga

SEQ ID NO: 695 - DNA, 20 bp, Artificial Sequence
  sequence targeting B2M
taagaaggcatgcactagac

SEQ ID NO: 696 - DNA, 20 bp, Artificial Sequence
  sequence targeting B2M
aagaaggcatgcactagact

SEQ ID NO: 697 - DNA, 20 bp, Artificial Sequence
  sequence targeting B2M
tgagtttgctgtctgtacat

SEQ ID NO: 698 - DNA, 20 bp, Artificial Sequence
  sequence targeting B2M
tacatcggcgccctccgatc

SEQ ID NO: 699 - DNA, 20 bp, Artificial Sequence
  sequence targeting B2M
acatcggcgccctccgatct

SEQ ID NO: 700 - DNA, 20 bp, Artificial Sequence
  sequence targeting B2M
catcggcgccctccgatctg

SEQ ID NO: 701 - DNA, 20 bp, Artificial Sequence
  sequence targeting B2M
ctggggtgcgcgccccagct

SEQ ID NO: 702 - DNA, 20 bp, Artificial Sequence
  sequence targeting B2M
tggggtgcgcgccccagctt

SEQ ID NO: 703 - DNA, 20 bp, Artificial Sequence
  sequence targeting B2M
cgcgccccagcttgggacac

SEQ ID NO: 704 - DNA, 20 bp, Artificial Sequence
  sequence targeting B2M
gcgccccagcttgggacacc

SEQ ID NO: 705 - DNA, 20 bp, Artificial Sequence
  sequence targeting B2M
caagtcacttagcatctctg

SEQ ID NO: 706 - DNA, 20 bp, Artificial Sequence
  sequence targeting B2M
acagaagttctccttctgct

SEQ ID NO: 707 - DNA, 20 bp, Artificial Sequence
  sequence targeting B2M
attcaaagatcttaatcttc

SEQ ID NO: 708 - DNA, 20 bp, Artificial Sequence
  sequence targeting B2M
ttcaaagatcttaatcttct

SEQ ID NO: 709 - DNA, 20 bp, Artificial Sequence
  sequence targeting B2M
ttttctcgaatgaaaaatgc

SEQ ID NO: 710 - DNA, 20 bp, Artificial Sequence
  sequence targeting B2M
tgcaggtccgagcagttaac

SEQ ID NO: 711 - DNA, 20 bp, Artificial Sequence
  sequence targeting B2M
ggtccgagcagttaactggc

SEQ ID NO: 712 - DNA, 20 bp, Artificial Sequence
  sequence targeting B2M
gtccgagcagttaactggct

SEQ ID NO: 713 - DNA, 20 bp, Artificial Sequence
  sequence targeting B2M
tccgagcagttaactggctg

SEQ ID NO: 714 - DNA, 20 bp, Artificial Sequence
  sequence targeting B2M
agcaagtcacttagcatctc

SEQ ID NO: 715 - DNA, 20 bp, Artificial Sequence
  sequence targeting B2M
gcaagtcacttagcatctct

SEQ ID NO: 716 - DNA, 20 bp, Artificial Sequence
  sequence targeting B2M
tggggccagtctgcaaagcg

SEQ ID NO: 717 - DNA, 20 bp, Artificial Sequence
  sequence targeting B2M
ggggccagtctgcaaagcga

SEQ ID NO: 718 - DNA, 20 bp, Artificial Sequence
  sequence targeting B2M
gggccagtctgcaaagcgag

SEQ ID NO: 719 - DNA, 20 bp, Artificial Sequence
  sequence targeting B2M
ggccagtctgcaaagcgagg

SEQ ID NO: 720 - DNA, 20 bp, Artificial Sequence
  sequence targeting B2M
ggacaccgggcgctcattct

SEQ ID NO: 721 - DNA, 20 bp, Artificial Sequence
  sequence targeting B2M
ggcgctcattctaggacttc

SEQ ID NO: 722 - DNA, 20 bp, Artificial Sequence
  sequence targeting B2M
ctcattctaggacttcaggc

SEQ ID NO: 723 - DNA, 20 bp, Artificial Sequence
  sequence targeting B2M
attctaggacttcaggctgg

SEQ ID NO: 724 - DNA, 20 bp, Artificial Sequence
  sequence targeting B2M
ttcaggctggaggcacatta

SEQ ID NO: 725 - DNA, 20 bp, Artificial Sequence
  sequence targeting B2M
tgccccctcgctttgcagac

SEQ ID NO: 726 - DNA, 20 bp, Artificial Sequence
  sequence targeting B2M
gatgctaagtgacttgctaa

SEQ ID NO: 727 - DNA, 20 bp, Artificial Sequence
  sequence targeting B2M
gccccagccagttaactgct

SEQ ID NO: 728 - DNA, 20 bp, Artificial Sequence
  sequence targeting B2M
gcatttttcattcgagaaaa

SEQ ID NO: 729 - DNA, 20 bp, Artificial Sequence
  sequence targeting B2M
tttgaatgctacctagcaga

SEQ ID NO: 730 - DNA, 20 bp, Artificial Sequence
  sequence targeting B2M
ttctgtttataactacagct

SEQ ID NO: 731 - DNA, 20 bp, Artificial Sequence
  sequence targeting B2M
tctgtttataactacagctt

SEQ ID NO: 732 - DNA, 21 bp, Artificial Sequence
  target B2M sequence complement
agagaatggaaagtcaaattt

SEQ ID NO: 733 - DNA, 21 bp, Artificial Sequence
  target B2M sequence complement
atggacatgatcttctttata

SEQ ID NO: 734 - DNA, 21 bp, Artificial Sequence
  target B2M sequence complement
tggacatgatcttctttataa

SEQ ID NO: 735 - DNA, 21 bp, Artificial Sequence
  target B2M sequence complement
ggacatgatcttctttataat

SEQ ID NO: 736 - DNA, 21 bp, Artificial Sequence
  target B2M sequence complement
tgacaggattattggaaattt

SEQ ID NO: 737 - DNA, 21 bp, Artificial Sequence
  target B2M sequence complement
ttgtggttaatctggtttatt

SEQ ID NO: 738 - DNA, 21 bp, Artificial Sequence
  target B2M sequence complement
tgtggttaatctggtttattt

SEQ ID NO: 739 - DNA, 21 bp, Artificial Sequence
  target B2M sequence complement
gcagagaatggaaagtcaaat

SEQ ID NO: 740 - DNA, 21 bp, Artificial Sequence
  target B2M sequence complement
cagagaatggaaagtcaaatt

SEQ ID NO: 741 - DNA, 21 bp, Artificial Sequence
  target B2M sequence complement
gagaatggaaagtcaaatttc

SEQ ID NO: 742 - DNA, 21 bp, Artificial Sequence
  target B2M sequence complement
gtcacagcccaagatagttaa

SEQ ID NO: 743 - DNA, 21 bp, Artificial Sequence
  target B2M sequence complement
tgcttatacacttacacttta

SEQ ID NO: 744 - DNA, 21 bp, Artificial Sequence
  target B2M sequence complement
gcttatacacttacactttat

SEQ ID NO: 745 - DNA, 21 bp, Artificial Sequence
  target B2M sequence complement
cttatacacttacactttatg

SEQ ID NO: 746 - DNA, 21 bp, Artificial Sequence
  target B2M sequence complement
acatggacatgatcttcttta

SEQ ID NO: 747 - DNA, 21 bp, Artificial Sequence
  target B2M sequence complement
catggacatgatcttctttat

SEQ ID NO: 748 - DNA, 21 bp, Artificial Sequence
  target B2M sequence complement
atcaacatcttggtcagattt

SEQ ID NO: 749 - DNA, 21 bp, Artificial Sequence
  target B2M sequence complement
cttgcactcaaagcttgttaa

SEQ ID NO: 750 - DNA, 21 bp, Artificial Sequence
  target B2M sequence complement
agttaagcgtgcataagttaa

SEQ ID NO: 751 - DNA, 21 bp, Artificial Sequence
  target B2M sequence complement
gcataagttaacttccaattt

SEQ ID NO: 752 - DNA, 21 bp, Artificial Sequence
  target B2M sequence complement
tacatactctgcttagaattt

SEQ ID NO: 753 - DNA, 21 bp, Artificial Sequence
  target B2M sequence complement
acatactctgcttagaatttg

SEQ ID NO: 754 - DNA, 21 bp, Artificial Sequence
  target B2M sequence complement
ttgacaggattattggaaatt

SEQ ID NO: 755 - DNA, 21 bp, Artificial Sequence
  target B2M sequence complement
gacaggattattggaaatttg

SEQ ID NO: 756 - DNA, 21 bp, Artificial Sequence
  target B2M sequence complement
taaggcatggttgtggttaat

SEQ ID NO: 757 - DNA, 21 bp, Artificial Sequence
  target B2M sequence complement
gttgtggttaatctggtttat

SEQ ID NO: 758 - DNA, 21 bp, Artificial Sequence
  target B2M sequence complement
gttccacaagttaaataaatc

SEQ ID NO: 759 - DNA, 21 bp, Artificial Sequence
  target B2M sequence complement
tccagcgtactccaaagattc

SEQ ID NO: 760 - DNA, 21 bp, Artificial Sequence
  target B2M sequence complement
tactccaaagattcaggttta

SEQ ID NO: 761 - DNA, 21 bp, Artificial Sequence
  target B2M sequence complement
actccaaagattcaggtttac

SEQ ID NO: 762 - DNA, 21 bp, Artificial Sequence
  target B2M sequence complement
cacgtcatccagcagagaatg

SEQ ID NO: 763 - DNA, 21 bp, Artificial Sequence
  target B2M sequence complement
ggtttcatccatccgacattg

SEQ ID NO: 764 - DNA, 21 bp, Artificial Sequence
  target B2M sequence complement
ccgacattgaagttgacttac

SEQ ID NO: 765 - DNA, 21 bp, Artificial Sequence
  target B2M sequence complement
tgaagaatggagagagaattg

SEQ ID NO: 766 - DNA, 21 bp, Artificial Sequence
  target B2M sequence complement
gagcattcagacttgtctttc

SEQ ID NO: 767 - DNA, 21 bp, Artificial Sequence
  target B2M sequence complement
ttcagcaaggactggtctttc

SEQ ID NO: 768 - DNA, 21 bp, Artificial Sequence
  target B2M sequence complement
gcaaggactggtctttctatc

SEQ ID NO: 769 - DNA, 21 bp, Artificial Sequence
  target B2M sequence complement
cgtgtgaaccatgtgactttg

SEQ ID NO: 770 - DNA, 21 bp, Artificial Sequence
  target B2M sequence complement
ctttgtcacagcccaagatag

SEQ ID NO: 771 - DNA, 21 bp, Artificial Sequence
  target B2M sequence complement
tcacagcccaagatagttaag

SEQ ID NO: 772 - DNA, 21 bp, Artificial Sequence
  target B2M sequence complement
agtgggatcgagacatgtaag

SEQ ID NO: 773 - DNA, 21 bp, Artificial Sequence
  target B2M sequence complement
aggtttgaagatgccgcattt

SEQ ID NO: 774 - DNA, 21 bp, Artificial Sequence
  target B2M sequence complement
ggtttgaagatgccgcatttg

SEQ ID NO: 775 - DNA, 21 bp, Artificial Sequence
  target B2M sequence complement
ttgatatgcttatacacttac

SEQ ID NO: 776 - DNA, 21 bp, Artificial Sequence
  target B2M sequence complement
tgagtgctgtctccatgtttg

SEQ ID NO: 777 - DNA, 21 bp, Artificial Sequence
  target B2M sequence complement
tgtctccatgtttgatgtatc

SEQ ID NO: 778 - DNA, 21 bp, Artificial Sequence
  target B2M sequence complement
tcaacatcttggtcagatttg

SEQ ID NO: 779 - DNA, 21 bp, Artificial Sequence
  target B2M sequence complement
tcagatttgaactcttcaatc

SEQ ID NO: 780 - DNA, 21 bp, Artificial Sequence
  target B2M sequence complement
ttcaatctcttgcactcaaag

SEQ ID NO: 781 - DNA, 21 bp, Artificial Sequence
  target B2M sequence complement
ttgcactcaaagcttgttaag

SEQ ID NO: 782 - DNA, 21 bp, Artificial Sequence
  target B2M sequence complement
actcaaagcttgttaagatag

SEQ ID NO: 783 - DNA, 21 bp, Artificial Sequence
  target B2M sequence complement
agatagttaagcgtgcataag

SEQ ID NO: 784 - DNA, 21 bp, Artificial Sequence
  target B2M sequence complement
tgcataagttaacttccaatt

SEQ ID NO: 785 - DNA, 21 bp, Artificial Sequence
  target B2M sequence complement
gttaacttccaatttacatac

SEQ ID NO: 786 - DNA, 21 bp, Artificial Sequence
  target B2M sequence complement
attgacaggattattggaaat

SEQ ID NO: 787 - DNA, 21 bp, Artificial Sequence
  target B2M sequence complement
gtaaggcatggttgtggttaa

SEQ ID NO: 788 - DNA, 21 bp, Artificial Sequence
  target B2M sequence complement
ggttgtggttaatctggttta

SEQ ID NO: 789 - DNA, 21 bp, Artificial Sequence
  target B2M sequence complement
ttcctgaagctgacagcattc

SEQ ID NO: 790 - DNA, 21 bp, Artificial Sequence
  target B2M sequence complement
gctatccagcgtactccaaag

SEQ ID NO: 791 - DNA, 21 bp, Artificial Sequence
  target B2M sequence complement
catccagcagagaatggaaag

SEQ ID NO: 792 - DNA, 21 bp, Artificial Sequence
  target B2M sequence complement
caaatttcctgaattgctatg

SEQ ID NO: 793 - DNA, 21 bp, Artificial Sequence
  target B2M sequence complement
attgctatgtgtctgggtttc

SEQ ID NO: 794 - DNA, 21 bp, Artificial Sequence
  target B2M sequence complement
gaagatgccgcatttggattg

SEQ ID NO: 795 - DNA, 21 bp, Artificial Sequence
  target B2M sequence complement
caatttacatactctgcttag

SEQ ID NO: 796 - DNA, 21 bp, Artificial Sequence
  target B2M sequence complement
tatccagcgtactccaaagat

SEQ ID NO: 797 - DNA, 21 bp, Artificial Sequence
  target B2M sequence complement
atccagcgtactccaaagatt

SEQ ID NO: 798 - DNA, 21 bp, Artificial Sequence
  target B2M sequence complement
ctccaaagattcaggtttact

SEQ ID NO: 799 - DNA, 21 bp, Artificial Sequence
  target B2M sequence complement
tgctatgtgtctgggtttcat

SEQ ID NO: 800 - DNA, 21 bp, Artificial Sequence
  target B2M sequence complement
tttcatccatccgacattgaa

SEQ ID NO: 801 - DNA, 21 bp, Artificial Sequence
  target B2M sequence complement
gaagttgacttactgaagaat

SEQ ID NO: 802 - DNA, 21 bp, Artificial Sequence
  target B2M sequence complement
gaagaatggagagagaattga

SEQ ID NO: 803 - DNA, 21 bp, Artificial Sequence
  target B2M sequence complement
agaatggagagagaattgaaa

SEQ ID NO: 804 - DNA, 21 bp, Artificial Sequence
  target B2M sequence complement
cagcaaggactggtctttcta

SEQ ID NO: 805 - DNA, 21 bp, Artificial Sequence
  target B2M sequence complement
agcaaggactggtctttctat

SEQ ID NO: 806 - DNA, 21 bp, Artificial Sequence
  target B2M sequence complement
actttgtcacagcccaagata

SEQ ID NO: 807 - DNA, 21 bp, Artificial Sequence
  target B2M sequence complement
ttgtcacagcccaagatagtt

SEQ ID NO: 808 - DNA, 21 bp, Artificial Sequence
  target B2M sequence complement
tgtcacagcccaagatagtta

SEQ ID NO: 809 - DNA, 21 bp, Artificial Sequence
  target B2M sequence complement
cacagcccaagatagttaagt

SEQ ID NO: 810 - DNA, 21 bp, Artificial Sequence
  target B2M sequence complement
gcagcatcatggaggtttgaa

SEQ ID NO: 811 - DNA, 21 bp, Artificial Sequence
  target B2M sequence complement
ccgcatttggattggatgaat

SEQ ID NO: 812 - DNA, 21 bp, Artificial Sequence
  target B2M sequence complement
ttgagtgctgtctccatgttt

SEQ ID NO: 813 - DNA, 21 bp, Artificial Sequence
  target B2M sequence complement
agtgctgtctccatgtttgat

SEQ ID NO: 814 - DNA, 21 bp, Artificial Sequence
  target B2M sequence complement
ctgtctccatgtttgatgtat

SEQ ID NO: 815 - DNA, 21 bp, Artificial Sequence
  target B2M sequence complement
tctaggagggctggcaactta

SEQ ID NO: 816 - DNA, 21 bp, Artificial Sequence
  target B2M sequence complement
caacatcttggtcagatttga

SEQ ID NO: 817 - DNA, 21 bp, Artificial Sequence
  target B2M sequence complement
gtcagatttgaactcttcaat

SEQ ID NO: 818 - DNA, 21 bp, Artificial Sequence
  target B2M sequence complement
tcttgcactcaaagcttgtta

SEQ ID NO: 819 - DNA, 21 bp, Artificial Sequence
  target B2M sequence complement
tgcactcaaagcttgttaaga

SEQ ID NO: 820 - DNA, 21 bp, Artificial Sequence
  target B2M sequence complement
gcactcaaagcttgttaagat

SEQ ID NO: 821 - DNA, 21 bp, Artificial Sequence
  target B2M sequence complement
cactcaaagcttgttaagata

SEQ ID NO: 822 - DNA, 21 bp, Artificial Sequence
  target B2M sequence complement
tcaaagcttgttaagatagtt

SEQ ID NO: 823 - DNA, 21 bp, Artificial Sequence
  target B2M sequence complement
caaagcttgttaagatagtta

SEQ ID NO: 824 - DNA, 21 bp, Artificial Sequence
  target B2M sequence complement
gatagttaagcgtgcataagt

SEQ ID NO: 825 - DNA, 21 bp, Artificial Sequence
  target B2M sequence complement
atagttaagcgtgcataagtt

SEQ ID NO: 826 - DNA, 21 bp, Artificial Sequence
  target B2M sequence complement
tagttaagcgtgcataagtta

SEQ ID NO: 827 - DNA, 21 bp, Artificial Sequence
  target B2M sequence complement
ttaagcgtgcataagttaact

SEQ ID NO: 828 - DNA, 21 bp, Artificial Sequence
  target B2M sequence complement
taagcgtgcataagttaactt

SEQ ID NO: 829 - DNA, 21 bp, Artificial Sequence
  target B2M sequence complement
atttacatactctgcttagaa

SEQ ID NO: 830 - DNA, 21 bp, Artificial Sequence
  target B2M sequence complement
tttacatactctgcttagaat

SEQ ID NO: 831 - DNA, 21 bp, Artificial Sequence
  target B2M sequence complement
acaggattattggaaatttgt

SEQ ID NO: 832 - DNA, 21 bp, Artificial Sequence
  target B2M sequence complement
caggattattggaaatttgtt

SEQ ID NO: 833 - DNA, 21 bp, Artificial Sequence
  target B2M sequence complement
aggcatggttgtggttaatct

SEQ ID NO: 834 - DNA, 21 bp, Artificial Sequence
  target B2M sequence complement
cagcagagaatggaaagtcaa

SEQ ID NO: 835 - DNA, 21 bp, Artificial Sequence
  target B2M sequence complement
tccgacattgaagttgactta

SEQ ID NO: 836 - DNA, 21 bp, Artificial Sequence
  target B2M sequence complement
ctggtctttctatctcttgta

SEQ ID NO: 837 - DNA, 21 bp, Artificial Sequence
  target B2M sequence complement
ccgtgtgaaccatgtgacttt

SEQ ID NO: 838 - DNA, 21 bp, Artificial Sequence
  target B2M sequence complement
cccaagatagttaagtgggat

SEQ ID NO: 839 - DNA, 21 bp, Artificial Sequence
  target B2M sequence complement
ggttgctccacaggtagctct

SEQ ID NO: 840 - DNA, 21 bp, Artificial Sequence
  target B2M sequence complement
gctccacaggtagctctagga

SEQ ID NO: 841 - DNA, 21 bp, Artificial Sequence
  target B2M sequence complement
gggagcagagaattctcttat

SEQ ID NO: 842 - DNA, 21 bp, Artificial Sequence
  target B2M sequence complement
ggagcagagaattctcttatc

SEQ ID NO: 843 - DNA, 21 bp, Artificial Sequence
  target B2M sequence complement
gagcagagaattctcttatcc

SEQ ID NO: 844 - DNA, 21 bp, Artificial Sequence
  target B2M sequence complement
gagaattctcttatccaacat

SEQ ID NO: 845 - DNA, 21 bp, Artificial Sequence
  target B2M sequence complement
gaattctcttatccaacatca

SEQ ID NO: 846 - DNA, 21 bp, Artificial Sequence
  target B2M sequence complement
aagtggagcattcagacttgt

SEQ ID NO: 847 - DNA, 21 bp, Artificial Sequence
  target B2M sequence complement
aaggactggtctttctatctc

SEQ ID NO: 848 - DNA, 21 bp, Artificial Sequence
  target B2M sequence complement
aagcttgttaagatagttaag

SEQ ID NO: 849 - DNA, 21 bp, Artificial Sequence
  target B2M sequence complement
aagcgtgcataagttaacttc

SEQ ID NO: 850 - DNA, 21 bp, Artificial Sequence
  target B2M sequence complement
aagatgccgcatttggattgg

SEQ ID NO: 851 - DNA, 21 bp, Artificial Sequence
  target B2M sequence complement
aagaatggagagagaattgaa

SEQ ID NO: 852 - DNA, 21 bp, Artificial Sequence
  target B2M sequence complement
aacatcaacatcttggtcaga

SEQ ID NO: 853 - DNA, 21 bp, Artificial Sequence
  target B2M sequence complement
aaggcatggttgtggttaatc

SEQ ID NO: 854 - DNA, 21 bp, Artificial Sequence
  target B2M sequence complement
aagcagcatcatggaggtttg

SEQ ID NO: 855 - DNA, 21 bp, Artificial Sequence
  target B2M sequence complement
aagatgagtatgcctgccgtg

SEQ ID NO: 856 - DNA, 21 bp, Artificial Sequence
  target B2M sequence complement
aagttgacttactgaagaatg

SEQ ID NO: 857 - DNA, 21 bp, Artificial Sequence
  target B2M sequence complement
aagatagttaagcgtgcataa

SEQ ID NO: 858 - DNA, 21 bp, Artificial Sequence
  target B2M sequence complement
aacttccaatttacatactct

SEQ ID NO: 859 - DNA, 21 bp, Artificial Sequence
  target B2M sequence complement
aacatcttggtcagatttgaa

SEQ ID NO: 860 - DNA, 21 bp, Artificial Sequence
  target B2M sequence complement
aactcttcaatctcttgcact

SEQ ID NO: 861 - DNA, 21 bp, Artificial Sequence
  target B2M sequence complement
aatttcctgaattgctatgtg

SEQ ID NO: 862 - DNA, 21 bp, Artificial Sequence
  target B2M sequence complement
aatggaaagtcaaatttcctg

SEQ ID NO: 863 - DNA, 21 bp, Artificial Sequence
  target B2M sequence complement
aaccatgtgactttgtcacag

SEQ ID NO: 864 - DNA, 21 bp, Artificial Sequence
  target B2M sequence complement
aattgacaggattattggaaa

SEQ ID NO: 865 - DNA, 21 bp, Artificial Sequence
  target B2M sequence complement
aattctcttatccaacatcaa

SEQ ID NO: 866 - DNA, 21 bp, Artificial Sequence
  target B2M sequence complement
aaagtggagcattcagacttg

SEQ ID NO: 867 - DNA, 21 bp, Artificial Sequence
  target B2M sequence complement
aaagtcaaatttcctgaattg

SEQ ID NO: 868 - DNA, 21 bp, Artificial Sequence
  target B2M sequence complement
gttgctccacaggtagctcta

SEQ ID NO: 869 - DNA, 21 bp, Artificial Sequence
  target B2M sequence complement
aatttacatactctgcttaga

SEQ ID NO: 870 - DNA, 21 bp, Artificial Sequence
  target HLA sequence complement
cttcttccttccctattaaaa

SEQ ID NO: 871 - DNA, 21 bp, Artificial Sequence
  target HLA sequence complement
tctcactccatgaggtatttc

SEQ ID NO: 872 - DNA, 21 bp, Artificial Sequence
  target HLA sequence complement
ctctcactccatgaggtattt

SEQ ID NO: 873 - DNA, 21 bp, Artificial Sequence
  target HLA sequence complement
gaggaggaagagctcagatag

SEQ ID NO: 874 - DNA, 21 bp, Artificial Sequence
  target HLA sequence complement
gctctcactccatgaggtatt

SEQ ID NO: 875 - DNA, 21 bp, Artificial Sequence
  target HLA sequence complement
aggattacatcgccctgaaag

SEQ ID NO: 876 - DNA, 21 bp, Artificial Sequence
  target HLA sequence complement
acaccgtccagaggatgtatg

SEQ ID NO: 877 - DNA, 21 bp, Artificial Sequence
  target HLA sequence complement
agggtccttcttcctggatac

SEQ ID NO: 878 - DNA, 21 bp, Artificial Sequence
  target HLA sequence complement
cctacgacggcaaggattaca

SEQ ID NO: 879 - DNA, 21 bp, Artificial Sequence
  target HLA sequence complement
tcactccatgaggtatttctt

SEQ ID NO: 880 - DNA, 21 bp, Artificial Sequence
  target HLA sequence complement
ctacgacggcaaggattacat

SEQ ID NO: 881 - DNA, 21 bp, Artificial Sequence
  target HLA sequence complement
ctcactccatgaggtatttct

SEQ ID NO: 882 - DNA, 21 bp, Artificial Sequence
  target HLA sequence complement
ggaggaagagctcagatagaa

SEQ ID NO: 883 - DNA, 21 bp, Artificial Sequence
  target HLA sequence complement
cacaccgtccagaggatgtat

SEQ ID NO: 884 - DNA, 21 bp, Artificial Sequence
  target HLA sequence complement
cacgctgtctctgaccatgaa

SEQ ID NO: 885 - DNA, 21 bp, Artificial Sequence
  target HLA sequence complement
ctggacaggagcagagataca

SEQ ID NO: 886 - DNA, 21 bp, Artificial Sequence
  target HLA sequence complement
tggaggaggaagagctcagat

SEQ ID NO: 887 - DNA, 21 bp, Artificial Sequence
  target HLA sequence complement
ggctctcactccatgaggtat

SEQ ID NO: 888 - DNA, 21 bp, Artificial Sequence
  target HLA sequence complement
catctctgtctcaacttcatg

SEQ ID NO: 889 - DNA, 21 bp, Artificial Sequence
  target HLA sequence complement
tacgacggcaaggattacatc

SEQ ID NO: 890 - DNA, 21 bp, Artificial Sequence
  target HLA sequence complement
ggattacatcgccctgaaaga

SEQ ID NO: 891 - DNA, 21 bp, Artificial Sequence
  target HLA sequence complement
gattacatcgccctgaaagag

SEQ ID NO: 892 - DNA, 21 bp, Artificial Sequence
  target HLA sequence complement
ctcagaccaccaagcacaagt

SEQ ID NO: 893 - DNA, 21 bp, Artificial Sequence
  target HLA sequence complement
tcacaccgtccagaggatgta

SEQ ID NO: 894 - DNA, 21 bp, Artificial Sequence
  target HLA sequence complement
actccatgaggtatttcttca

SEQ ID NO: 895 - DNA, 21 bp, Artificial Sequence
  target HLA sequence complement
cactccatgaggtatttcttc

SEQ ID NO: 896 - DNA, 21 bp, Artificial Sequence
  target HLA sequence complement
ccatgaggtatttcttcacat

SEQ ID NO: 897 - DNA, 21 bp, Artificial Sequence
  target HLA sequence complement
acttcttccttccctattaaa

SEQ ID NO: 898 - DNA, 21 bp, Artificial Sequence
  target HLA sequence complement
gtgtctctcacagcttgtaaa

SEQ ID NO: 899 - DNA, 21 bp, Artificial Sequence
  target HLA sequence complement
ctgtgttcgtgtaggcataat

SEQ ID NO: 900 - DNA, 21 bp, Artificial Sequence
  target HLA sequence complement
tgtgttcgtgtaggcataatg

SEQ ID NO: 901 - DNA, 21 bp, Artificial Sequence
  target HLA sequence complement
taacttcttccttccctatta

SEQ ID NO: 902 - DNA, 21 bp, Artificial Sequence
  target HLA sequence complement
tctggacaggagcagagatac

SEQ ID NO: 903 - DNA, 21 bp, Artificial Sequence
  target HLA sequence complement
ttgctggcctggttctctttg

SEQ ID NO: 904 - DNA, 21 bp, Artificial Sequence
  target HLA sequence complement
tgtctctcacagcttgtaaag

SEQ ID NO: 905 - DNA, 21 bp, Artificial Sequence
  target HLA sequence complement
acttgaagaaccctgactttg

SEQ ID NO: 906 - DNA, 21 bp, Artificial Sequence
  target HLA sequence complement
gaagaaccctgactttgtttc

SEQ ID NO: 907 - DNA, 21 bp, Artificial Sequence
  target HLA sequence complement
tctgtgttcgtgtaggcataa

SEQ ID NO: 908 - DNA, 21 bp, Artificial Sequence
  target HLA sequence complement
catggtgcactgagctgtaac

SEQ ID NO: 909 - DNA, 21 bp, Artificial Sequence
  target HLA sequence complement
gtaacttcttccttccctatt

SEQ ID NO: 910 - DNA, 21 bp, Artificial Sequence
  target HLA sequence complement
catgtgcagcatgagggtttg

SEQ ID NO: 911 - DNA, 21 bp, Artificial Sequence
  target HLA sequence complement
ttgttcctgcccttccctttg

SEQ ID NO: 912 - DNA, 21 bp, Artificial Sequence
  target HLA sequence complement
acccagttctcactcccattg

SEQ ID NO: 913 - DNA, 21 bp, Artificial Sequence
  target HLA sequence complement
gggtttccagagaagccaatc

SEQ ID NO: 914 - DNA, 21 bp, Artificial Sequence
  target HLA sequence complement
ttctccctctcccaacctatg

SEQ ID NO: 915 - DNA, 21 bp, Artificial Sequence
  target HLA sequence complement
gtctctcacagcttgtaaagt

SEQ ID NO: 916 - DNA, 21 bp, Artificial Sequence
  target HLA sequence complement
tgtgtctctcacagcttgtaa

SEQ ID NO: 917 - DNA, 21 bp, Artificial Sequence
  target HLA sequence complement
gaggaagagctcagatagaaa

SEQ ID NO: 918 - DNA, 21 bp, Artificial Sequence
  target HLA sequence complement
tgaagaaccctgactttgttt

SEQ ID NO: 919 - DNA, 21 bp, Artificial Sequence
  target HLA sequence complement
ttgaagaaccctgactttgtt

SEQ ID NO: 920 - DNA, 21 bp, Artificial Sequence
  target HLA sequence complement
gtgttcgtgtaggcataatgt

SEQ ID NO: 921 - DNA, 21 bp, Artificial Sequence
  target HLA sequence complement
tggtgcactgagctgtaactt

SEQ ID NO: 922 - DNA, 21 bp, Artificial Sequence
  target HLA sequence complement
ctccctctcccaacctatgta

SEQ ID NO: 923 - DNA, 21 bp, Artificial Sequence
  target HLA sequence complement
aggaggaagagctcagataga

SEQ ID NO: 924 - DNA, 21 bp, Artificial Sequence
  target HLA sequence complement
acctatgtagggtccttcttc

SEQ ID NO: 925 - DNA, 21 bp, Artificial Sequence
  target HLA sequence complement
gggtccttcttcctggatact

SEQ ID NO: 926 - DNA, 21 bp, Artificial Sequence
  target HLA sequence complement
ggtccttcttcctggatactc

SEQ ID NO: 927 - DNA, 21 bp, Artificial Sequence
  target HLA sequence complement
gtccttcttcctggatactca

SEQ ID NO: 928 - DNA, 21 bp, Artificial Sequence
  target HLA sequence complement
aagccaatcagtgtcgtcgcg

SEQ ID NO: 929 - DNA, 21 bp, Artificial Sequence
  target HLA sequence complement
aagaggacctgcgctcttgga

SEQ ID NO: 930 - DNA, 21 bp, Artificial Sequence
  target HLA sequence complement
aagtgtgagacagctgccttg

SEQ ID NO: 931 - DNA, 21 bp, Artificial Sequence
  target HLA sequence complement
aaggcacctgcatgtgtctgt

SEQ ID NO: 932 - DNA, 21 bp, Artificial Sequence
  target HLA sequence complement
aatcatctttcctgttccaga

SEQ ID NO: 933 - DNA, 21 bp, Artificial Sequence
  target HLA sequence complement
aaaggcacctgcatgtgtctg

SEQ ID NO: 934 - DNA, 21 bp, Artificial Sequence
  target HLA sequence complement
aaagaggacctgcgctcttgg

SEQ ID NO: 935 - DNA, 21 bp, Artificial Sequence
  target HLA sequence complement
aaacgcatatgactcaccacg

SEQ ID NO: 936 - DNA, 19 bp, Artificial Sequence
  target HLA sequence complement
ggaagagctcagatagaaa

SEQ ID NO: 937 - DNA, 19 bp, Artificial Sequence
  target HLA sequence complement
gggagacacggaaagtgaa

SEQ ID NO: 938 - DNA, 21 bp, Artificial Sequence
  target HLA sequence complement
cacctgccatgtgcagcatga

SEQ ID NO: 939 - DNA, 21 bp, Artificial Sequence
  target HLA sequence complement
ggagatcacactgacctggca

SEQ ID NO: 940 - DNA, 20 bp, Artificial Sequence
  target HLA sequence complement
ggattacatcgccctgaaag

SEQ ID NO: 941 - DNA, 20 bp, Artificial Sequence
  target HLA sequence complement
gcaggagggtccggagtatt

SEQ ID NO: 942 - DNA, 20 bp, Artificial Sequence
  target HLA sequence complement
ggacggggagacacggaaag

SEQ ID NO: 943 - DNA, 19 bp, Artificial Sequence
  target HLA sequence complement
gaaagtgaaggcccactca

SEQ ID NO: 944 - DNA, 20 bp, Artificial Sequence
  target HLA sequence complement
gatacctggagaacgggaag

SEQ ID NO: 945 - DNA, 20 bp, Artificial Sequence
  target HLA sequence complement
gctgtggtggtgccttctgg

SEQ ID NO: 946 - DNA, 20 bp, Artificial Sequence
  target HLA sequence complement
gctactacaaccagagcgag

SEQ ID NO: 947 - DNA, 19 bp, Artificial Sequence
  target HLA sequence complement
gtggctccgcagatacctg

SEQ ID NO: 948 - DNA, 19 bp, Artificial Sequence
  target HLA sequence complement
gccaatcagtgtcgtcgcg

SEQ ID NO: 949 - DNA, 19 bp, Artificial Sequence
  target HLA sequence complement
gaggacctgcgctcttgga

SEQ ID NO: 950 - DNA, 19 bp, Artificial Sequence
  target HLA sequence complement
gtgtgagacagctgccttg

SEQ ID NO: 951 - DNA, 19 bp, Artificial Sequence
  target HLA sequence complement
ggcacctgcatgtgtctgt

SEQ ID NO: 952 - DNA, 19 bp, Artificial Sequence
  target HLA sequence complement
tcatctttcctgttccaga

SEQ ID NO: 953 - DNA, 19 bp, Artificial Sequence
  target HLA sequence complement
aggcacctgcatgtgtctg

SEQ ID NO: 954 - DNA, 19 bp, Artificial Sequence
  target HLA sequence complement
agaggacctgcgctcttgg

SEQ ID NO: 955 - DNA, 19 bp, Artificial Sequence
  target HLA sequence complement
acgcatatgactcaccacg

SEQ ID NO: 956 - RNA, 2 nt, Artificial Sequence
  5' Flank Sequence
gg

SEQ ID NO: 957 - RNA, 23 nt, Artificial Sequence
  5' Flank Sequence
acaccauguugccagucucuagg

SEQ ID NO: 958 - RNA, 23 nt, Artificial Sequence
  5' Flank Sequence
ugauagcaaugucagcagugccu

SEQ ID NO: 959 - RNA, 23 nt, Artificial Sequence
  5' Flank Sequence
uauugcuguugacagugagcgac

SEQ ID NO: 960 - RNA, 21 nt, Artificial Sequence
  3' Flank Sequence
uggcgucuggcccaaccacac

SEQ ID NO: 961 - RNA, 21 nt, Artificial Sequence
  3' Flank Sequence
guaagguugaccauacucuac

SEQ ID NO: 962 - RNA, 4 nt, Artificial Sequence
  Loop Region Sequence
cgaa

SEQ ID NO: 963 - RNA, 7 nt, Artificial Sequence
  Loop Region Sequence
uucaaga

SEQ ID NO: 964 - RNA, 7 nt, Artificial Sequence
  Loop Region Sequence
auauuca

SEQ ID NO: 965 - RNA, 9 nt, Artificial Sequence
  Loop Region Sequence
ugugcuguc

SEQ ID NO: 966 - RNA, 6 nt, Artificial Sequence
  Loop Region Sequence
cucgag

SEQ ID NO: 967 - RNA, 12 nt, Artificial Sequence
  Loop Region Sequence
cuuccugucaga

SEQ ID NO: 968 - RNA, 15 nt, Artificial Sequence
  Loop Region Sequence
cuucccuuugucaga

SEQ ID NO: 969 - RNA, 12 nt, Artificial Sequence
  Loop Region Sequence
guguuauucuug

SEQ ID NO: 970 - RNA, 12 nt, Artificial Sequence
  Loop Region Sequence
gugucuuaauug

SEQ ID NO: 971 - RNA, 12 nt, Artificial Sequence
  Loop Region Sequence
guguuagucuug

SEQ ID NO: 972 - RNA, 7 nt, Artificial Sequence
  Loop Region Sequence
ucaagag

SEQ ID NO: 973 - RNA, 12 nt, Artificial Sequence
  Loop Region Sequence
ggacauccaggg

SEQ ID NO: 974 - RNA, 15 nt, Artificial Sequence
  Loop Region Sequence
gugaagccacagaug

SEQ ID NO: 975 - RNA, 10 nt, Artificial Sequence
  Loop Region Sequence
gauucuaaaa

SEQ ID NO: 976 - DNA, 20 bp, Artificial Sequence
  gRNA targeting sequence
gatctgactttatgacgtgt

SEQ ID NO: 977 - DNA, 20 bp, Artificial Sequence
  gRNA targeting sequence
ccttcacattccgtgtctcc

SEQ ID NO: 978 - DNA, 20 bp, Artificial Sequence
  gRNA targeting sequence
acagcgacgccgcgagccag

SEQ ID NO: 979 - DNA, 20 bp, Artificial Sequence
  gRNA targeting sequence
ttcacatccgtgtcccggcc

SEQ ID NO: 980 - DNA, 51 bp, Artificial Sequence; identical to SEQ ID NO: 168
  linker

SEQ ID NO: 981 - protein, 118 aa, Artificial Sequence
  anti-HLA-A*02 scFv - LILRB1 VH
QVQLQQSGPELVKPGASVRISCKASGYTFTSYHIHWVKQRPGQGLEWIGWIYPGNVNTEYNEKFKGKATLTADKSSSTAYMHLSSLTSEDSAVYFCAREEITYAMDYWGQGTSVTVSS

SEQ ID NO: 982 - DNA, 354 bp, Artificial Sequence
  anti-HLA-A*02 scFv - LILRB1 VH
caggtccagctgcagcagtctggacctgagctggtgaagccaggggcttcagtgaggatatcctgtaaggcctctggctacacctttacaagttaccatatacattgggtgaagcagaggcctggacagggactcgaatggattggatggatttatcctggaaatgttaatactgagtacaatgagaagttcaagggcaaggccacactgactgcagacaaatcgtccagcacagcctacatgcacctcagcagcctgacctctgaggactctgcggtctatttctgtgccagagaggagattacctatgctatggattattggggtcaaggaacctcagtcaccgtgtcctca

SEQ ID NO: 983 - protein, 4 aa, Unknown
  immunoreceptor tyrosine-based activation motif
  SITE (2)..(3): Xaa is any amino acid
  SITE (4)..(4): Xaa is Leu or Ile
YXXX

SEQ ID NO: 984 - protein, 6 aa, Unknown
  immunoreceptor tyrosine-based activation motif
  SITE (1)..(1): Xaa is Ser, Ile, Val or Leu
  SITE (2)..(2): Xaa is any amino acid
  SITE (4)..(5): Xaa is any amino acid
  SITE (6)..(6): Xaa is Ile, Val or Leu
XXYXXX

What is claimed is:

1. An immune cell comprising:
   a. a first receptor, comprising an extracellular ligand binding domain specific to CEA cell adhesion molecule 5 (CEA); and
   b. a second receptor, comprising an extracellular ligand binding domain specific to HLA-A*02,
   wherein the first receptor is an activator receptor responsive to CEA; and wherein the second receptor is an inhibitory receptor responsive to HLA-A*02;
   wherein the extracellular ligand binding domain of the first receptor comprises a variable heavy (VH) portion comprising complementarity determining regions (CDRs) CDR-H1, CDR-H2, and CDR-H3 of SEQ ID NOs: 55, 56, and 57, respectively, and a variable light (VL) portion comprising CDRs CDR-L1, CDR-L2, and CDR-L3 of SEQ ID NOs: 59, 61, and 63, respectively; and
   wherein the extracellular ligand binding domain of the second receptor comprises a VH portion comprising CDRs CDR-H1, CDR-H2, and CDR-H3 of SEQ ID NOs: 106, 107, and 108, respectively, and a VL portion comprising CDRs CDR-L1, CDR-L2, and CDR-L3 of SEQ ID NOs: 103, 104, and 105, respectively.

2. The immune cell of claim 1, wherein the extracellular ligand binding domain of the first receptor comprises a VH portion comprising SEQ ID NO: 144 or a sequence having at least 85% identity thereto, and a VL portion comprising SEQ ID NO: 148 or a sequence having at least 85% identity thereto.

3. The immune cell of claim 1, wherein the extracellular ligand binding domain of the second receptor comprises a VH portion comprising SEQ ID NO: 981 or a sequence having at least 85% identity thereto, and a VL portion comprising SEQ ID NO: 166 or a sequence having at least 85% identity thereto.

4. The immune cell of claim 1, wherein the extracellular ligand binding domain of the first receptor comprises an scFv sequence of SEQ ID NO: 68 or a sequence having at least 85% identity thereto.

5. The immune cell of claim 1, wherein the extracellular ligand binding domain of the second receptor comprises an scFv sequence of SEQ ID NO: 91 or a sequence having at least 85% identity thereto.

6. The immune cell of claim 1, wherein the first receptor is a chimeric antigen receptor (CAR) comprising a hinge domain, a transmembrane domain and an intracellular domain.

7. The immune cell of claim 6, wherein the hinge domain of the first receptor comprises a CD8α hinge domain.

8. The immune cell of claim 7, wherein the CD8α hinge domain of the first receptor comprises a sequence of SEQ ID NO: 71, or a sequence having at least 85% identity thereto.

9. The immune cell of claim 6, wherein the transmembrane domain of the first receptor comprises a CD28 transmembrane domain.

10. The immune cell of claim 9, wherein the CD28 transmembrane domain of the first receptor comprises a sequence of SEQ ID NO: 75, or a sequence having at least 85% identity thereto.

11. The immune cell of claim 6, wherein the intracellular domain of the first receptor comprises a CD28 co-stimulatory domain, a 4-1BB co-stimulatory domain, and a CD3ζ activation domain.

12. The immune cell of claim 11, wherein the intracellular domain of the first receptor comprises a sequence of SEQ ID NO: 158, or a sequence having at least 85% identity thereto.

13. The immune cell of claim 1, wherein the first receptor comprises a sequence of SEQ ID NO: 52, or a sequence having at least 90% identity thereto.

14. The immune cell of claim 1, wherein the second receptor comprises a LILRB1 intracellular domain.

15. The immune cell of claim 14, wherein the LILRB1 intracellular domain comprises a sequence at least 90%, or is identical to SEQ ID NO: 131.

16. The immune cell of claim 1, wherein the second receptor comprises a LILRB1 transmembrane domain.

17. The immune cell of claim 16, wherein the LILRB1 transmembrane domain comprises a sequence at least 90% or is identical to SEQ ID NO: 135.

18. The immune cell of claim 1, wherein the second receptor comprises a LILRB1 hinge domain.

19. The immune cell of claim 18, wherein the LILRB1 hinge domain comprises a sequence at least 90% or is identical to SEQ ID NO: 134.

20. The immune cell of claim 1, wherein the second receptor comprises a sequence of SEQ ID NO: 164, or a sequence having at least 90% identity thereto.

21. The immune cell of claim 1, wherein the immune cell is a T cell, an NK cell or a macrophage.

22. A pharmaceutical composition, comprising a therapeutically effective amount of the immune cell of claim 1 and a pharmaceutically acceptable carrier, diluent or excipient.

23. The immune cell of claim 1, wherein the extracellular ligand binding domain of the second receptor comprises a VH portion comprising SEQ ID NO: 981 or a sequence having at least at least 95% thereto, and a VL portion comprising SEQ ID NO: 166 or a sequence having at least 95% identity thereto.

24. The immune cell of claim 23, wherein the extracellular ligand binding domain of the first receptor comprises a VH portion comprising SEQ ID NO: 144 or a sequence having at least 95% thereto, and a VL portion comprising SEQ ID NO: 148 or a sequence at least 95% identity thereto.

25. The immune cell of claim 23, wherein the extracellular ligand binding domain of the first receptor comprises an scFv sequence of SEQ ID NO: 68 or at least 95% identity thereto.

26. The immune cell of claim 1, wherein the extracellular ligand binding domain of the second receptor comprises an scFv sequence of SEQ ID NO: 91 or a sequence having at least 95% identity thereto.

27. The immune cell of claim 1, wherein the extracellular ligand binding domain of the second receptor comprises a VH portion comprising SEQ ID NO: 981, and a VL portion comprising SEQ ID NO: 166.

28. The immune cell of claim 27, wherein the extracellular ligand binding domain of the first receptor comprises a VH portion comprising SEQ ID NO: 144, and a VL portion comprising SEQ ID NO: 148.

29. The immune cell of claim 1, wherein the extracellular ligand binding domain of the first receptor comprises an scFv sequence of SEQ ID NO: 68; and wherein the extracellular ligand binding domain of the second receptor comprises an scFv sequence of SEQ ID NO: 91.

30. The immune cell of claim 1, wherein the immune cell is a T cell.

* * * * *